(12) United States Patent
Wolfe et al.

(10) Patent No.: US 8,748,575 B2
(45) Date of Patent: Jun. 10, 2014

(54) THERAPEUTIC PEPTIDES

(75) Inventors: Henry Wolfe, Glenmoore, PA (US);
Reinhard Ebner, Gaithersburg, MD (US)

(73) Assignee: Combimab, Inc., Chevy Chase, MD (US)

( * ) Notice: Subject to any disclaimer, the term of this patent is extended or adjusted under 35 U.S.C. 154(b) by 0 days.

(21) Appl. No.: 13/984,523

(22) PCT Filed: Jun. 8, 2011

(86) PCT No.: PCT/US2011/039572
§ 371 (c)(1),
(2), (4) Date: Aug. 8, 2013

(87) PCT Pub. No.: WO2011/156453
PCT Pub. Date: Dec. 15, 2011

(65) Prior Publication Data
US 2014/0038881 A1    Feb. 6, 2014

Related U.S. Application Data

(60) Provisional application No. 61/352,973, filed on Jun. 9, 2010.

(51) Int. Cl.
| | |
|---|---|
| *A61K 38/04* | (2006.01) |
| *C07K 7/08* | (2006.01) |
| *C07K 7/00* | (2006.01) |
| *C07K 1/107* | (2006.01) |
| *C07K 1/00* | (2006.01) |
| *A61K 38/10* | (2006.01) |
| *A61K 38/00* | (2006.01) |
| *A61P 1/10* | (2006.01) |

(52) U.S. Cl.
USPC ........... 530/327; 530/333; 530/344; 530/345; 514/21.5; 514/1.1; 424/78.01

(58) Field of Classification Search
None
See application file for complete search history.

(56) References Cited

U.S. PATENT DOCUMENTS

| | | | |
|---|---|---|---|
| 5,962,220 A  * | 10/1999 | Waldman | 435/6.14 |
| 7,304,036 B2 * | 12/2007 | Currie et al. | 514/12.2 |
| 2004/0029182 A1* | 2/2004 | Waldman | 435/7.1 |
| 2005/0287067 A1* | 12/2005 | Wolfe et al. | 424/1.69 |
| 2008/0118525 A1* | 5/2008 | Donini et al. | 424/185.1 |

FOREIGN PATENT DOCUMENTS

| | | | | |
|---|---|---|---|---|
| WO | WO9511694 | * | 5/1995 | A61K 38/10 |
| WO | WO2004069165 | * | 8/2004 | C07K 7/08 |
| WO | WO2004071436 | * | 8/2004 | A61K 38/00 |
| WO | WO2010099234 | * | 9/2010 | A61K 38/00 |
| WO | WO2010147684 | * | 12/2010 | A61K 35/74 |
| WO | WO2012149263 | * | 11/2012 | A61K 38/00 |
| WO | WO2012161921 | * | 11/2012 | A61K 38/10 |

OTHER PUBLICATIONS http://www.drugs.com/linzess.html. Revision Date Nov. 14, 2012.*
http://en.wikipedia.org/wiki/Linaclotide. Last Modified Nov. 19, 2013.*

* cited by examiner

*Primary Examiner* — Maury Audet
(74) *Attorney, Agent, or Firm* — Michele M. Wales; InHouse Patent Counsel, LLC

(57) ABSTRACT

Therapeutic peptides having guanylyl cyclase C agonist activity are disclosed. The therapeutic peptides are analogues of the *E. coli* STa peptide with non-natural amino acid, isosteric or D-amino acid substituents. The therapeutic peptides are useful in the treatment of chronic ideopathic constipation, inflammatory bowel disease, and other diseases. Pharmaceutical compositions comprising the therapeutic peptides are also disclosed.

12 Claims, 22 Drawing Sheets

SPD-10Avp
Ch1-215nm
Results

| Retention Time | Area | Area % | Height | Height % |
|---|---|---|---|---|
| 4.953 | 142245 | 1.37 | 12308 | 1.47 |
| 7.143 | 22246 | 0.21 | 1385 | 0.17 |
| 7.730 | 27086 | 0.26 | 2863 | 0.34 |
| 8.247 | 10036679 | 96.73 | 811058 | 96.96 |
| 8.857 | 147196 | 1.42 | 8861 | 1.06 |

UV Detector
Ch1-215nm
Results

| Retention Time | Area | Area % | Height | Height % |
|---|---|---|---|---|
| 8.573 | 8801280 | 97.99 | 973531 | 98.29 |
| 9.310 | 46314 | 0.52 | 2817 | 0.28 |
| 9.673 | 129021 | 1.44 | 13623 | 1.38 |
| 11.777 | 5173 | 0.06 | 455 | 0.05 |

SPD-10Avp
Ch1-215nm
Results

| Retention Time | Area | Area % | Height | Height % |
|---|---|---|---|---|
| 6.853 | 92127 | 1.66 | 5548 | 0.97 |
| 8.040 | 5276122 | 95.07 | 543061 | 94.47 |
| 8.287 | 181249 | 3.27 | 26268 | 4.57 |

SPD-10Avp
Ch1-215nm
Results

| Retention time | Area | Area % | Height | Height % |
|---|---|---|---|---|
| 7.680 | 6120583 | 99.39 | 534375 | 99.34 |
| 8.437 | 37791 | 0.61 | 3577 | 0.66 |

THERAPEUTIC PEPTIDES

CROSS-REFERENCE TO RELATED APPLICATIONS

This Application is the National Phase under 35 U.S.C. §371 of PCT International Application No. PCT/US2011/039572 which has an international filing date of Jun. 8, 2011, which claims priority to 61/352,973 filed on Jun. 9, 2010. The entire contents of these applications listed above are hereby incorporated by reference.

BACKGROUND OF THE INVENTION

The present invention relates to methods and compositions for the treatment of gastrointestinal disorders, cancer, cardiovascular disorders, obesity, benign prostatic hyperplacia, disorders of the lung, disorders of the eye, inflammatory disorders, and other disorders. In particular the invention is useful for the treatment of disorders of the gastrointestinal tract, including constipation, irritable bowel syndrome, inflammatory bowel disease, Crohn's disease, diarrhea, ulcerative colitis and other gastrointestinal digestive or motility disorders. The compounds disclosed herein are peptides and peptide analogues which bind to the cellular receptor protein guanylyl cyclase (GC) or Guanylate Cyclase C (also named GCC, GC-C, Guanylyl cyclase C, GUC2C, GUCY2C, guanylate cyclase 2C, heat-stable enterotoxin receptor, hSTAR, intestinal guanylate cyclase, STAR, STA receptor, guanylate cyclase C receptor, GCCR). In some embodiments, the peptides and peptide analogues are agonists and activate the signaling pathway that is activated by the binding of the natural GCC ligands to GCC. In some embodiments, the peptides and peptide analogues block binding of natural ligands of GCC but do not activate the signaling pathway activated by the binding of the natural GCC ligands to GCC. The compounds may be used either alone or in combination with other compounds.

Guanylate Cyclase C (GCC) is a type 1 (membrane bound) guanylate cyclase. Guanylate Cyclase C receptors (GCCR) are found in a number of different tissues in the human body (Vaandrager, 2002), but it is predominately present in the gastrointestinal tract. Agonists to the human GCCR include the natural peptide hormones Guanylin and Uroguanylin, as well as a number of bacterial peptides, including the ST peptides that are produced by *Escherichia coli* and other bacteria (Currie et al., 1992; Tian et al., 2008; Giannella & Mann, 2003; Hamra et al., 1993; Forte, 1999; Schulz et al., 1990; Guba et al., 1996; Joo et al., 1998).

GCC regulates the fluid balance, inflammatory processes and the balance of proliferation and differentiation of the epithelium in the intestine (Evan & Vousden, 2001; Eastwood, 1992; Li et al., 2007a; Bharucha & Waldman, 2010; Sharma et al., 2010; Weiglmeier et al., 2010). The intestinal epithelium is dynamic, with a well-defined vertical axis extending from the crypt depths, in the wall of the intestine, to the tips of villi which project out into the lumen of the intestine. Epithelial cells are "born" at or near the bottom of crypts as daughter cells produced by intestinal stem cells. Recent work with lineage tracing in transgenic animals has offered evidence that—at least in the mouse intestine—cells with stem cell characteristics reside in a narrow band a few cell layers above the crypt bottom (Barker et al., 2007). These daughter cells continue to divide (proliferate), and their progeny migrates up the wall of the crypt toward the tip of the villus. Along this migration, the cells shift from proliferation to differentiation to become fully-functional mature enterocytes with the capacity to perform the normal functions of the gut including digestion, absorption and secretion. Once at the tip, these cells slough off into the lumen of the intestine and die. Thus, the intestinal epithelium turns over every three to five days. GCC and its endogenous ligands appear to be one of the factors that mirror the shift of epithelial cells from proliferation to differentiation along the crypt-villus axis. Indeed, GCC ligands inhibit the proliferation of these cells and change their gene expression pattern to a more terminally-differentiated state (Pitari et al., 2001).

The binding of endogenous (uroguanylin and guanylin) and exogenous ligands (the methanol-soluble, heat stable enterotoxins) to the extracellular domain of GCCR activates the intracellular guanylyl cyclase domain of this receptor, producing cGMP. One of the results of this increase in intracellular cGMP is activation of cGMP-dependent protein kinase (CGKII) and subsequent phosphorylation of the cystic fibrosis transmembrane conductance regulator (CFTR). This phosphorylation of CFTR opens its ion channel with subsequent efflux of chloride ions from the enterocytes, followed by the passage of counterions (i.e. Na) and water into the intestinal lumen. In addition to CFTR, other transporters of electrolytes may also possibly be involved in this process, as well as other receptors (Seidler et al., 1997; Vaandrager et al., 1997).

One of the clinical manifestations of reduced CFTR activity in cystic fibrosis patients is the inflammation of airway passages. This effect may be due to CTFR regulating the expression of NF-kB, chemokines and cytokines. Recent reports have also suggested that the CFTR channel is involved in the transport and maintenance of reduced glutathione, an antioxidant that plays an important role in protecting against inflammation caused by oxidative stress (Colin-Bisello et al., 2005). Enhancement of intracellular levels of cGMP by way of guanylate cyclase C activation would be expected to down-regulate these inflammatory stimuli. Thus, GCC agonists should be useful in the prevention and treatment of inflammatory diseases of the lung (e.g., asthma), bowel (e.g., ulcerative colitis and Crohn's disease), pancreas and other organs.

Guanylin and Uroguanylin mediated signaling via cGMP is important to the normal function of the gut. Guanylin and Uroguanylin serve as paracrine regulators of GCCR activity in the intestine and therefore regulate electrolyte and fluid transport in the GI tract. Abnormalities or disturbance of this process contribute to gastrointestinal disorders such as Chronic Idiopathic Constipation (CIC), Irritable Bowel Syndrome (IBS) and Celiac disease (Collins, 2007; Ramamoorthy et al., 2007; Collins & Bercik, 2009). These receptors also influence inflammatory conditions and cell proliferation, and abnormalities in the process can also lead to conditions such as Inflammatory Bowel Disorders (IBD) or Cancers (Shailubhai et al., 2000; Shailubhai, 2002; Li et al., 2007b; Askling et al., 2001).

Chronic Idiopathic Constipation and Irritable Bowel Syndrome are disorders of the gut that are a cause of discomfort and pain. In these conditions there is no serious inflammatory involvement, although there may be a low grade of inflammation present. The pathology involves altered motility, decreased stool hydration, and visceral sensitivity. Underlying causes may include the involvement of 5-HT (5-hydroxytryptamine, serotonin), which is regulated by cGMP. An alteration in the renewal of the mucosa may also be involved along with a change in the apoptosis rate of cells in the intestinal tissue, which may also influence oncogenic processes (Carrithers, 2003; Bharucha, 2010; Lin et al, 2010). The definition and diagnosis of CIC and IBS have been established in the Rome Criteria (Drossman, 1999). CIC and IBS are classified as a functional gastrointestinal disorders, resulting from a combination of altered bowel motility and an increased visceral sensitivity. In CIC, the bowel motility is lowered and stool hydration is reduced. There are three main subgroups of IBS; constipation dominant, diarrhea dominant, or mixed which alternates between constipation and diarrhea. In all IBS conditions bowel motility is altered and there is an increased visceral sensitivity. Both CIC and IBS are very prevalent condition, affecting at least 10 million people in the United States alone.

Inflammatory Bowel Disease describes a group of disorders where the intestine is inflamed. These include Ulcerative Colitis and Crohn's disease. Ulcerative Colitis is an inflammatory disorder of the colon, although it can also appear in other sections of the intestine. Ulcerative Colitis affects only the mucosa of the intestine. Crohn's disease is a serious condition that affects mainly the colon and ileum, but it can also be found in other parts of the intestine. In Crohn's disease, all layers of the intestine are affected. Depending on the location in the intestine, Crohn's disease can also be called enteritis or colitis.

Diarrheal diseases are the fourth leading cause of mortality worldwide, responsible for about 20 million deaths each year. Such diseases are the leading cause of pediatric mortality worldwide, particularly affecting children under 5 years of age. Further, diarrheal diseases are responsible for a large part of the more prevalent growth retardation observed in children raised in developing compared to developed nations. One major cause of diarrheal disease are organisms producing heat-stable enterotoxins (STs), a family of structurally-related peptides produced by a variety of species including, but not limited to enteric bacteria such as *E. coli, Yersinia, Enterobacter,* and *Vibrio*. This family of structurally-related ST peptides is homologous to the endogenous peptides guanylin and uroguanylin produced in the mammalian intestine. ST-producing organisms are a major cause of endemic diarrhea in under-developed countries, the leading cause of travelers' diarrhea, and the leading cause of diarrheal disease in agriculturally-important animal populations (scours) in developed and under-developed countries. It is estimated that the annual incidence of ST-induced diarrheal disease numbers in the billions in animals and humans. ST induces diarrhea by binding to GCC, which is selectively expressed in the brush border membranes of intestinal epithelial cells and is the presumed receptor for the endogenous ligands guanylin and uroguanylin. Interaction of ST, or the endogenous ligands guanylin and uroguanylin, with GCC activates that receptor, resulting in the production of intracellular cyclic GMP. Cyclic GMP, through a signaling cascade, induces the secretion of salt and water into the lumen of the intestine, resulting in diarrhea. It has been suggested that one function for the endogenous ligands guanylin and uroguanylin in normal physiology is the regulation of fluid and electrolyte homeostasis in the intestine, and the hydration of intestinal contents (e.g. stool). Thus, it is possible to use analogues of ST peptides as therapeutic agents to affect the state of, or prevent, many diseases where GCC plays a role.

Overall, it may be concluded that agonists of guanylate cyclase C have potential therapeutic value in the treatment of a number of conditions, including constipation, irritable bowel syndrome, and a wide variety of inflammatory conditions, as well as potential use as anti-metastatic agents in the treatment of cancer. The development of new agonists is therefore of substantial clinical importance.

Natural GCCR Agonist Peptide Species

There are a number of different peptides with similarity to Guanylin and Uroguanylin that have been identified in different animal species, including obvious species orthologs as well as more distant homologs, but they all have significant structure and significant sequence homologies (Schulz, 1992; Krause et al., 1997; Nakazato, 2001). All mammalian Guanylins and Uroguanylins are structurally related peptides, typically 15 to 16 amino acids in length, that contain two disulphide bonds (Forte, 1999; Magert, 1998).

The amino acid sequences for the mature forms of Guanylin (Table 1A), Uroguanylin (Table 1B) in a number of vertebrate species, and of some bacterial ST peptides (Table 1C) are listed in the tables below:

TABLE 1A

Overview of Guanylin amino acid sequences

| Species | Genbank | SEQ ID NO | 1 | 2 | 3 | 4 | 5 | 6 | 7 | 8 | 9 | 10 | 11 | 12 | 13 | 14 | 15 | 16 | (mature peptide) Publication |
|---|---|---|---|---|---|---|---|---|---|---|---|---|---|---|---|---|---|---|---|
| | | | | | | Position from N-terminus | | | | | | | | | | | | | |
| | | | | | | Amino acid sequence shown in publication | | | | | | | | | | | | | |
| Human | NP_291031.2 | 1 | P | G | T | C | E | I | C | A | Y | A | A | C | T | G | C | | Schulz, 1992 |
| Chimpanzee | NW_001230449.1 | 2 | P | G | T | C | E | I | C | A | Y | A | A | C | T | G | C | | |
| Macaque | XP_001085421.1 | 3 | P | S | T | C | E | I | C | A | Y | A | A | C | T | G | C | | |
| Rat | CAA47901.1 | 4 | P | N | T | C | E | I | C | A | Y | A | A | C | T | G | C | | |
| Mouse | NP_032216.1 | 5 | P | N | T | C | E | I | C | A | Y | A | A | C | T | G | C | | |
| Pig | NP_001153746.1 | 6 | P | S | T | C | E | I | C | A | Y | A | A | C | A | G | C | | |
| Cow | NP_001192919.1 | 7 | P | S | T | C | E | I | C | A | Y | A | A | C | A | G | C | | |
| Sheep | EF654536.1 | 8 | P | S | T | C | E | I | C | A | Y | A | A | C | A | G | C | | |
| Dog | NP_001185717.1 | 9 | P | R | S | C | E | I | C | A | F | A | A | C | A | G | C | | |
| Horse | XP_001503217.1 | 10 | P | R | M | C | E | I | C | A | F | A | A | C | A | G | C | | |
| G. Panda | EFB17789.1 | 11 | P | S | V | C | E | I | C | A | F | A | A | C | A | G | C | | |
| Opossum | XP_001381608.1 | 12 | S | H | T | C | E | I | C | A | F | A | A | C | A | G | C | | |
| Platypus | XP_001505889.1 | 13 | D | D | L | C | E | L | C | A | F | A | A | C | T | G | C | Y | |

Note:
Guanylin species contains disulphide bonds between cysteines in position 4 and 12, and between position 7 and 15.

TABLE 1B

Overview of Uroguanylin amino acid sequences

| Species | Genbank | SEQ ID NO | 1 | 2 | 3 | 4 | 5 | 6 | 7 | 8 | 9 | 10 | 11 | 12 | 13 | 14 | 15 | 16 | Publication |
|---|---|---|---|---|---|---|---|---|---|---|---|---|---|---|---|---|---|---|---|
| Human | | 14 | N | D | D | C | E | L | C | V | N | V | A | C | T | G | C | L | Marx et al., 1998 |
| Chimpanzee | XP_524686.2 | 15 | N | D | D | C | E | L | C | V | N | V | A | C | T | G | C | L | |
| Macaque | XP_001087987.1 | 16 | N | D | D | C | E | L | C | V | N | V | A | C | T | G | C | L | |
| Horse | XP_001497636.1 | 17 | N | D | D | C | E | L | C | V | N | V | A | C | T | G | C | L | |
| Cow | NP_001192745.1 | 18 | N | D | D | C | E | L | C | V | N | V | A | C | T | G | C | S | |
| Pig | NP_001153747.1 | 19 | G | D | D | C | E | L | C | V | N | V | A | C | T | G | C | S | |
| Guinea p. | NP_001166429.1 | 20 | N | D | E | C | E | L | C | V | N | I | A | C | T | G | C | | |
| Rat | NP_071620.1 | 21 | T | D | E | C | E | L | C | I | N | V | A | C | T | G | C | | |
| Mouse | CAM14649.1 | 22 | T | D | E | C | E | L | C | I | N | V | A | C | T | G | C | | |
| Sheep | ABR67874.1 | 23 | D | D | D | C | E | L | C | V | N | V | A | C | T | G | C | | |
| Hopping m. | AAL77417.1 | 24 | T | D | E | C | E | L | C | I | N | V | A | C | T | G | C | | |
| Opossum | AAB00553.1 | 25 | Q | E | D | C | E | L | C | I | N | V | A | C | T | G | C | | Virginia |
| Opossum | XP_001367002.1 | 26 | Q | D | D | C | E | I | C | I | N | V | A | C | T | G | C | | short tailed |
| Platypus | XP_001505889.1 | 27 | N | D | D | C | E | L | C | T | N | A | A | C | T | G | C | Y | |

Note:
Mature Uroguanylin contains disulphide bonds between position 4 and 12, and between position 7 and 15.

TABLE 1C

Overview of ST peptide amino acid sequences

| Species | SEQ ID NO: | -1 | 1 | 2 | 3 | 4 | 5 | 6 | 7 | 8 | 9 | 10 | 11 | 12 | 13 | 14 | 15 | 16 | 17 | 18 | 19 | Publication |
|---|---|---|---|---|---|---|---|---|---|---|---|---|---|---|---|---|---|---|---|---|---|---|
| *E. coli* STa | 28 | | N | T | F | Y | C | C | E | L | C | C | N | P | A | C | A | G | C | Y | | |
| *E. coli* STp | 29 | | N | T | F | Y | C | C | E | L | C | C | N | P | A | C | T | G | C | Y | | Takao et al., 1983 |
| *E. coli* STh | 30 | N | S | S | N | Y | C | C | E | L | C | C | N | P | A | C | T | G | C | Y | | Nair & Takeda, 1998 |
| *V. cholerae* n01 | 31 | | N | T | I | D | C | C | E | I | C | C | N | P | F | C | T | G | C | L | N | Arita et al., 1991a |
| *Vibrio mimicus* | 32 | | N | T | I | D | C | C | E | I | C | C | N | P | F | C | T | G | C | L | N | Arita et al., 1991b |
| *V. cholerae* n01(H) | 33 | | N | L | I | D | C | C | E | I | C | C | N | P | F | C | T | G | C | L | N | Takao et al., 1985a |
| *V. Cholerae* 01 | 34 | G | N | L | I | D | C | C | E | I | C | C | N | P | F | C | T | G | C | L | N | Yoshino et al., 1993 |
| *Y. enterocolitica* STa | 35 | | V | S | S | D | W | D | C | D | V | C | C | N | P | A | C | T | G | C | | | Takao et al., 1984 |
| *Y. enterocolitica* STb | 36 | | E | E | N | D | D | W | C | E | V | C | C | N | P | A | C | T | G | C | | | Takao et al., 1985b |
| *Y. enterocolitica* STc | 37 | | G | E | N | W | D | W | C | E | L | C | C | N | P | A | C | T | G | C | | | Delor et al., 1990 |
| *Ctrobacter freundii* | 38 | | N | N | T | T | Y | C | E | L | C | C | N | P | A | C | T | G | C | | | | Giannella, 1995 |

Table with overview of selected known ST peptide species.
Mature ST peptides have disulphide bonds between positions 5 and 10, 6 and 14, and 9 and 17.

The bacterial ST peptides are structurally different from the Guanylin and Uroguanylin peptides. These peptides are typically from 18 to 22 peptides in length, and contain three disulphide bonds (Ikemura 1984; Nair, 1998). A common core motif of all these bacterial peptides is:

N-tail-Cys-Cys-Xaa-Xaa-Cys-Cys-Xaa-Xaa-Xaa-Cys-Xaa-Xaa-Cys-C-tail Where N-tail is the N-terminal tail of the peptide, typically four to six amino acids long, and C-tail is the C-terminal tail of the peptide, typically one amino acid. Xaa can be several different amino acids. While there is some variation in the composition of the Xaa amino acids in these peptides, there is significant sequence homology between them, and the pattern of Cys-Cys-(2 amino acids)-Cyc-Cys-(3 amino acids)-Cys-(2 amino acids)-Cys is quite constant. Bacterial ST peptides are more potent stimulators of the GCCR than are Guanylin or Uroguanylin (Hamra et al., 1993; Fan et al., 1997; Hamra et al., 1997; Santos-Neto et al., 1999; Forte et al., 2000; Pitari et al., 2001). There are a number of different variants of ST peptides produced by various bacteria (Yoshimura et al., 1985). The core active sequence, i.e. the core pharmacophore, of the peptide are the 13 amino acids between the cysteine residues, i.e. the sequence Cys-Cys-Xaa-Xaa-Cys-Cys-Xaa-Xaa-Xaa-Cys-Xaa-Xaa-Cys. The activity of the ST peptide is fully retained if this structure is intact. If any of the disulphide bonds is disrupted, the activity of the peptide will be significantly degraded (Yamasaki et al., 1988; Yamasaki et al, 1988, Bull. Chem. Soc. Jpn, 61: 1701-1706), although with at least 2 of the disulphide bonds intact, the peptide can retain a portion of its activity (Tian et al., 2008) (Tian et al, 2008, Biopolymers (Pept Sci) 90: 713-723).

The ST peptide has been analyzed, and analogues have been described in a number of publications (see for instance Currie et al., 2006—WO/2006/086653; Waldman & August, 2006—U.S. Pat. No. 7,097,839; Shailubhai & Jacob, 2010—US 2010/0093635 A1). The published peptides analogues that have been made and tested involve modifications to the peptide in one of four modes: 1) Modifications using natural L-amino acids, 2) Modifications using D-amino acids, 3) Modifications to the cysteine bonds of the peptide, and 4) modifications involving conjugation of polymers to the peptide. None of these modifications have resulted in a peptide with improved properties compared to that of the basic 13 amino acid core pharmacophore, such as improved potency, stability or solubility (Tian et al., 2008).

SUMMARY OF THE INVENTION

The present invention involves compositions and related methods for treating conditions involving Guanylate Cyclase, in particular the Guanylate Cyclase C receptor (GCC), as well as conditions that respond to enhanced intracellular levels of cGMP. Intracellular levels of cGMP can be increased by enhancing the intracellular production of cGMP and/or by inhibition of its degradation by cGMP-specific enzymes such as phosphodiesterases. As described herein, the GCC is expressed on various cell types including on gastrointestinal epithelial cells, but also on cells of extra-intestinal tissues such as adrenal gland, heart, kidney, fetal liver, lung, pancreas, pituitary, and male and female reproductive tissues (Vaandrager, 2002).

The peptides of the invention may be used to treat gastrointestinal disorders including disorders involving increasing or decreasing gastrointestinal motility, inflammatory disorders, cancers, cardiac disorders, oral disorders, endocrine disorders, disorders of the lung, eye, blood, liver, prostate, and obesity. Examples of such disorders are irritable bowel syndrome (IBS), non-ulcer and functional dyspepsia, chronic intestinal and colonic pseudo-obstruction, duodenogastric and gastroesophageal reflux disease, ileus inflammation (including post-operative ileus), gastroparesis, high acidity in the GI tract, constipation including surgical constipation and constipation associated with use of medications such as opioids or osteoarthritis and osteoporosis drugs as well as constipation associated with neuropathic disorders, and Meniere's disease. Inflammatory disorders include, for instance, tissue and organ inflammation, for example kidney inflammation, gastrointestinal system inflammation including Crohn's disease and ulcerative colitis, pancreatic inflammation, lung inflammation including bronchitis or asthma, or skin inflammations such as psoriasis and eczema. Lung Disorders include chronic obstructive pulmonary disease and lung fibrosis. Cancers include tissue, organ and blood cancers and metastases such as gastrointestinal cancer, gastric cancer, and cancers of the esophagus, pancreas, colorectum, intestine, liver, gallbladder, lung, anus, thyroid, kidney, blood, skin (including melanoma), oral cavity and urinary tract. Endocrine disorders include diabetes mellitus, cystic fibrosis, hyperthyroidism, and hypothyroidism. Cardiac disorders include high cholesterol, or high triglycerides, congestive heart failure and trachea cardia hypertension. Liver disorders include cirrhosis and fibrosis and conditions associated with liver transplants. Eye disorders include glaucoma, eye inflammation, increased intra-ocular pressure, dry eyes, retinal degeneration and tear gland disorders. Skin disorders include xerosis and rosacea. Oral disorders include dry mouth, xerostomia, Sjogren's syndrome, gum diseases, periodontal disease, and salivary gland duct blockage. Prostate disorders include benign prostatic hyperplasia.

The present invention provides compounds that bind to GCC. Endogenous ligands of GCC and enterotoxins known to bind to GCC are characterized as having two or three disulphide bonds cross-linking a peptide pharmacophore with significant sequence homology. The compounds of the invention have three disulfides which cross-link a 13 amino acid pharmacophore which includes at least one non-native or isosteric amino acid substitution. The compounds of the invention bind to the GCC receptor and activate the GCC pathway. Some compounds may also bind to the GCC receptor but not activate the pathway. Some aspects of the present invention relate to these compounds and to methods of using them.

Non-limiting examples of preferred peptides included in this invention are listed below:

```
Peptide A (SEQ ID NO: 60):
H2N Cys Cys Glu Leu Cys Cys Asn Dhp Ala Cys Ala

Gly Cys Tyr COOH

Peptide B (SEQ ID NO: 61):
H2N Cys Cys Glu L-Thr Cys Cys Asn Pro Ala Cys Ala

Gly Cys Tyr COOH

Peptide C (SEQ ID NO: 62):
H2N Cys Cys Glu Leu Cys Cys Asn HyPro Ala Cys Ala

Gly Cys Tyr COOH

Peptide D (SEQ ID NO: 63):
H2N Cys Cys Glu Leu Cys Cys Asn Thz Ala Cys Ala

Gly Cys Tyr COOH
```

Additional preferred peptides are shown in table 3A, 3B, 3C and 8A below.

BRIEF DESCRIPTION OF THE DRAWINGS

FIG. 1 illustrates threonine analogue structures that are useful substituents in the therapeutic peptides of the present invention.

FIG. 2 illustrates proline analogue structures that are useful substituents in the therapeutic peptides of the present invention.

FIG. 3 illustrates phenylalanine analogue structures that are useful substituents in the therapeutic peptides of the present invention.

FIG. 4 is a plot of GCC receptor binding activity and density in the intestine of male Sprague Dawley rats. $B_{max}$ from 1-125 ST (1-18) displacement, in Qian et al., Endocrinology 141: 3210-3224 (2000).

FIG. 5 is a plot of GCC receptor binding affinity and density in the intestine of newborn calves. $B_{max}$ from 1125 ST (1-18) displacement, (in Al-Majali et al., FEMS 28: 97-104 (2000).

FIG. 6 is a plot of GCC receptor affinity for STa (1-18) across the intestine, specifically, a plot of pKi ($-\log K_i$) data from 1125 ST (1-18) displacement assay described in Qian et al., Endocrinology 141: 3210-3224 (2000) and Al-Majali et al., FEMS 28: 97-104 (2000). The intestine sections are those used in Qian et al., 2000.

FIG. 7 is a plot of GCC receptor Activity Induced STa (1-18) across the intestine, specifically, a plot of normalized data (percent of maximum) from intracellular cGMP accumulation, guanylyl cyclase kinetics and net fluid secretion in intestinal loop assays as described in Qian, et al, Endocrinology, 141: 3210-3224 (2000), Krause, Gut, 35: 1250 (1994) and Cohen, Am. J. Physiology, 257: G118 (1989), respectively. The intestine sections are those used in Qian et al., 2000.

FIGS. 8-a and 8b are plots of GCC receptor Activity Induced STa (1-18) across the intestine, specifically, plots of net fluid transport into ligated intestinal loops from Sprague Dawley and Wistar rats, as described in Cohen, Am. J. Physiology 257: G118 (1989) and Nzegwu, Exp. Physiology 79: 547 (1994), respectively. FIG. 8a is GCC Activation time in Sprague Dawley rats. FIG. 8b is GCC Activation time in Wistar rats.

Figure 16:
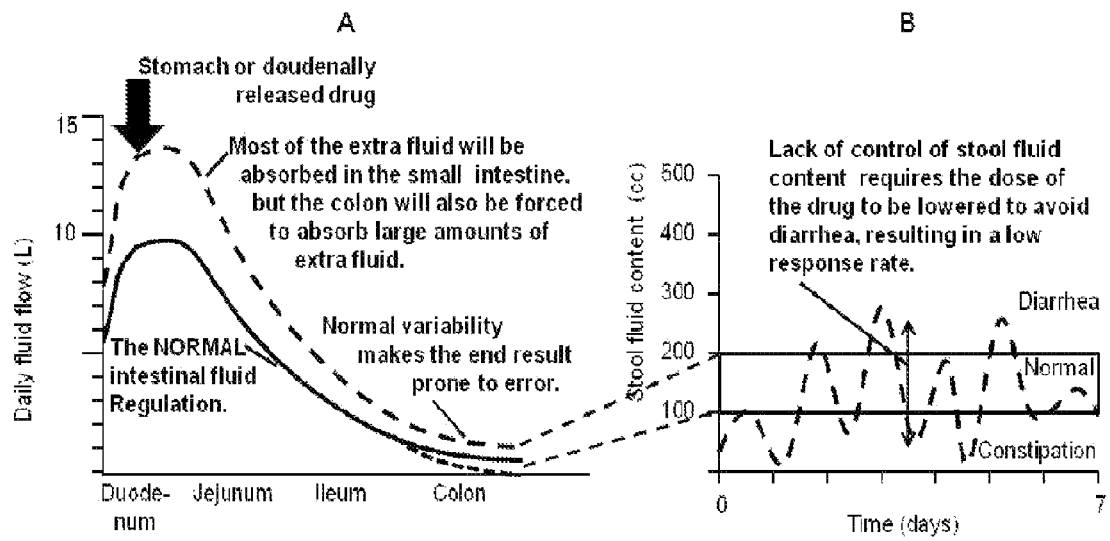

FIG. 16: is a plot illustrating intestinal fluid flow and stool hydration control where a drug is released in the stomach or duodenum.

Figure 17:
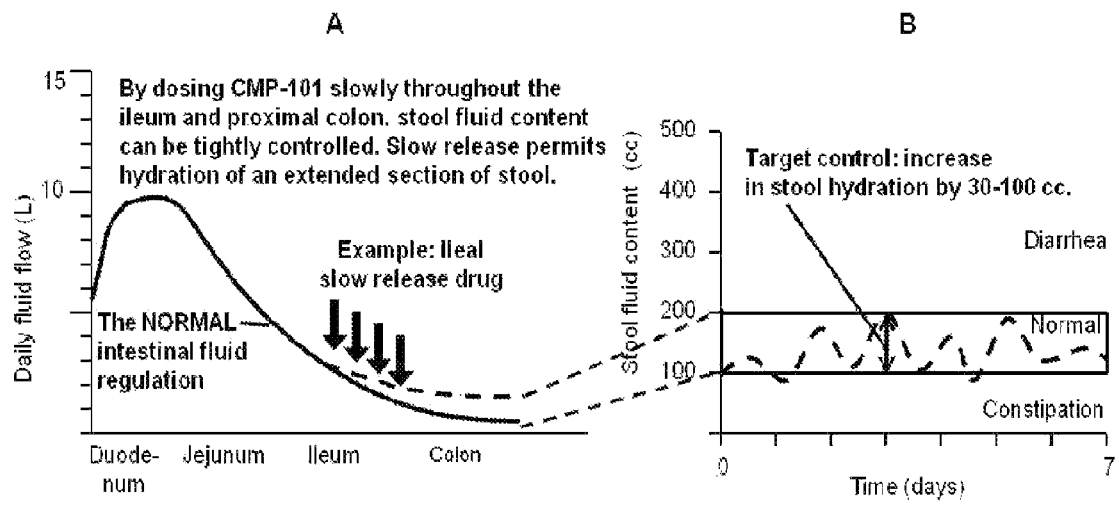

FIG. 17 is a plot illustrating intestinal fluid flow and stool hydration control where a drug having a slow release formulation is released in the ileum.

Figure 18:
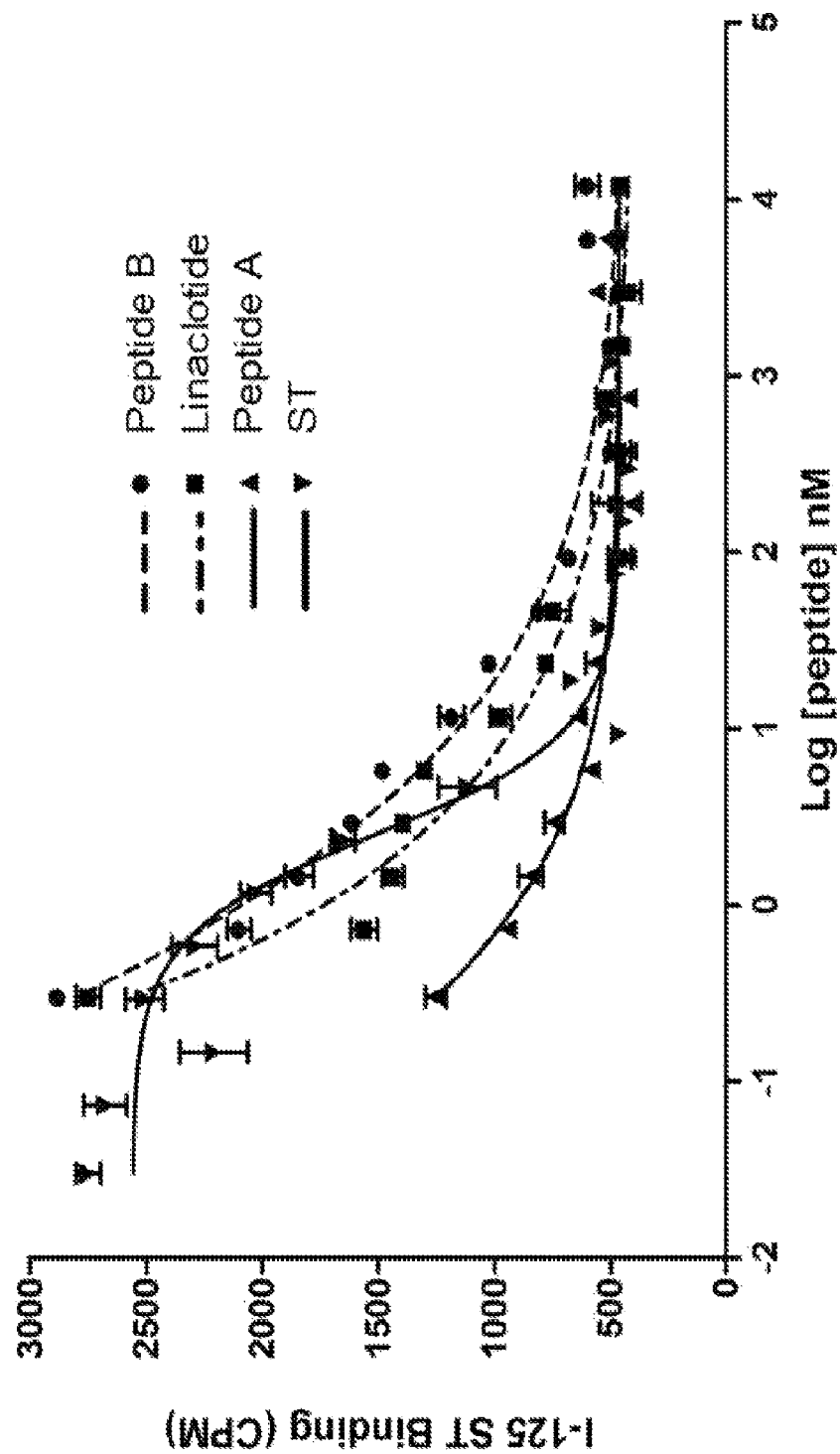

FIG. 18 is a comparative plot of the results of an 1-125 binding assay.

Figure 19:
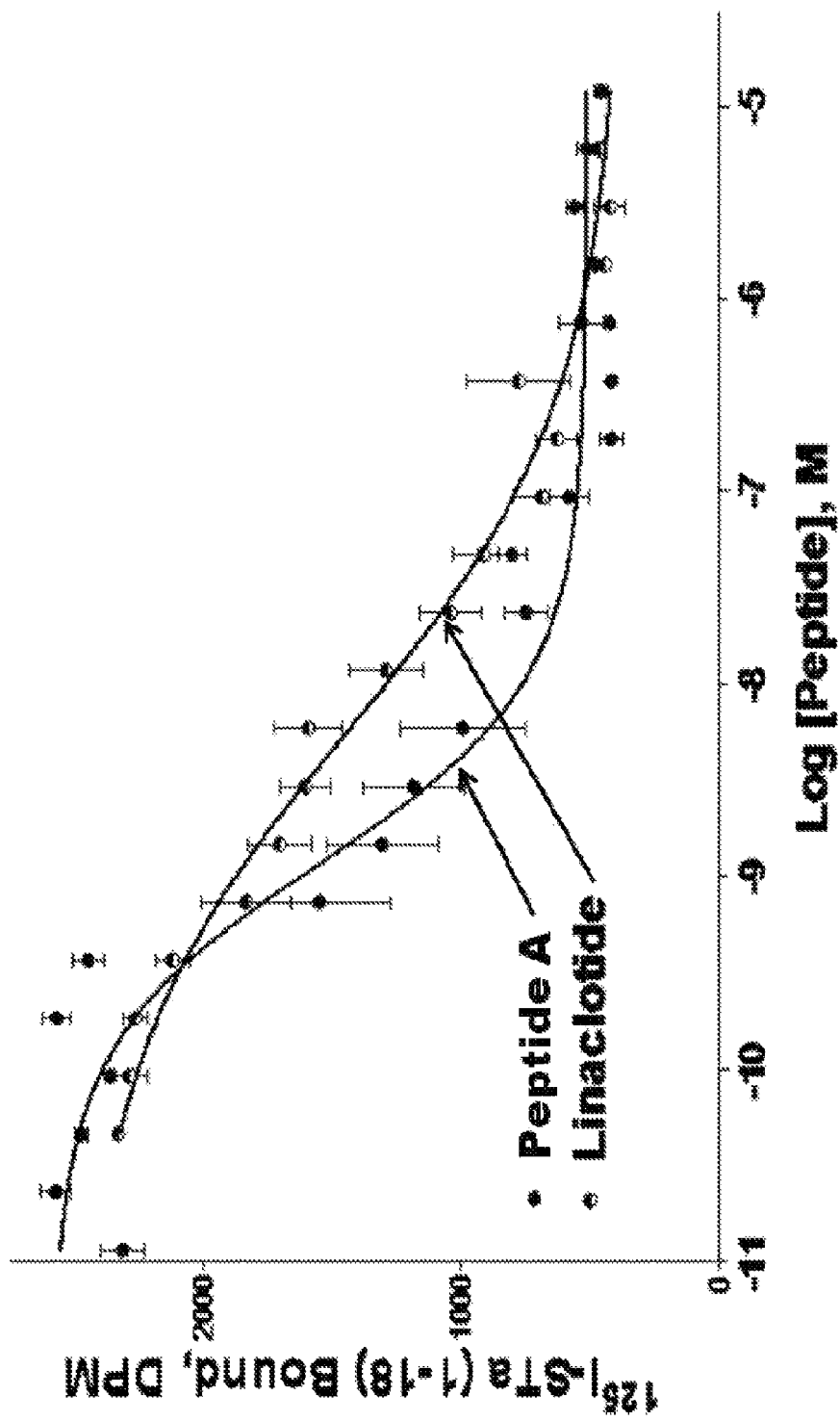

FIG. 19 is a comparative plot of the results of an 1-125 binding assay.

Figure 20:
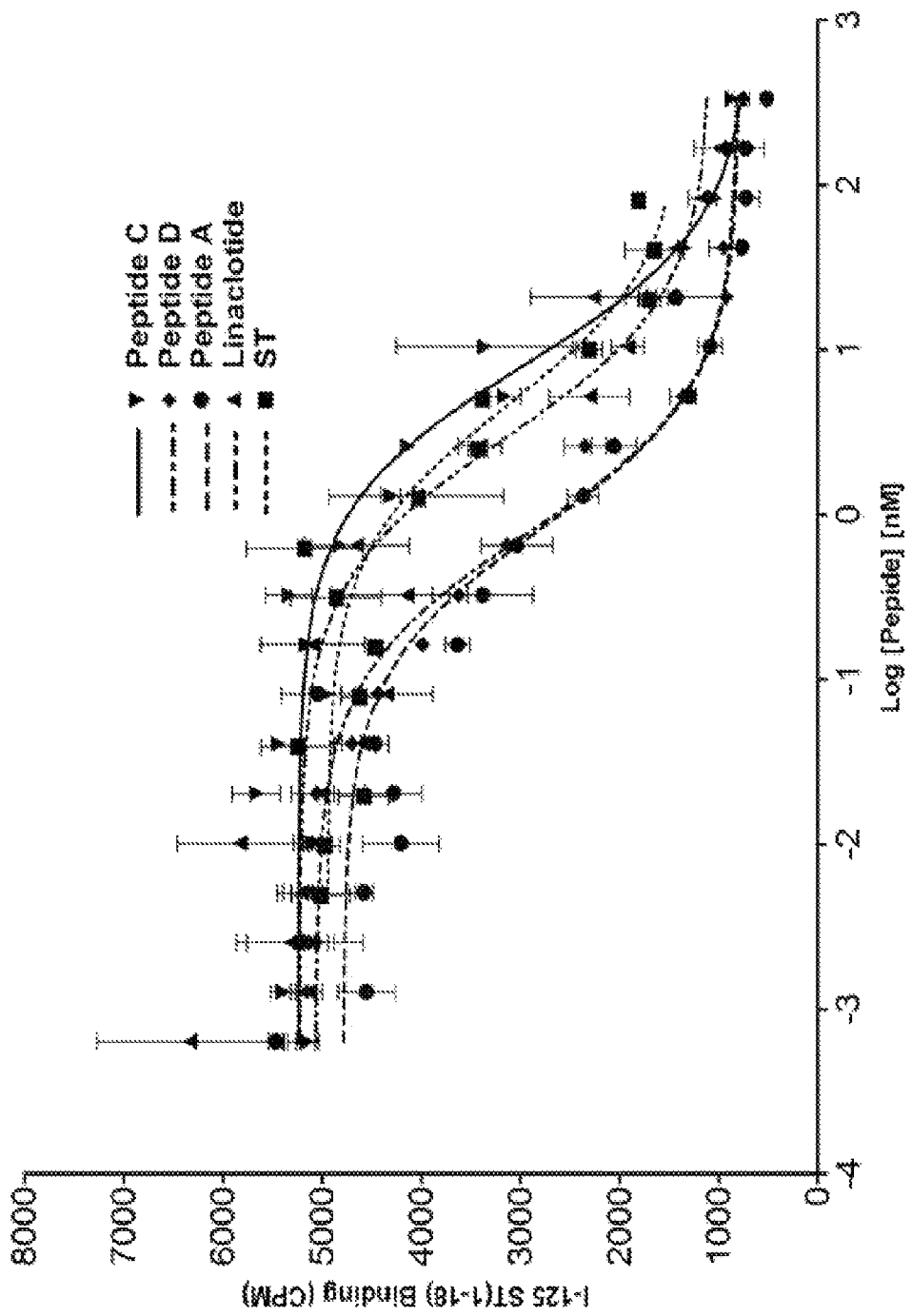

FIG. 20 is a comparative plot of the results of an 1-125 binding assay.

Figure 21:
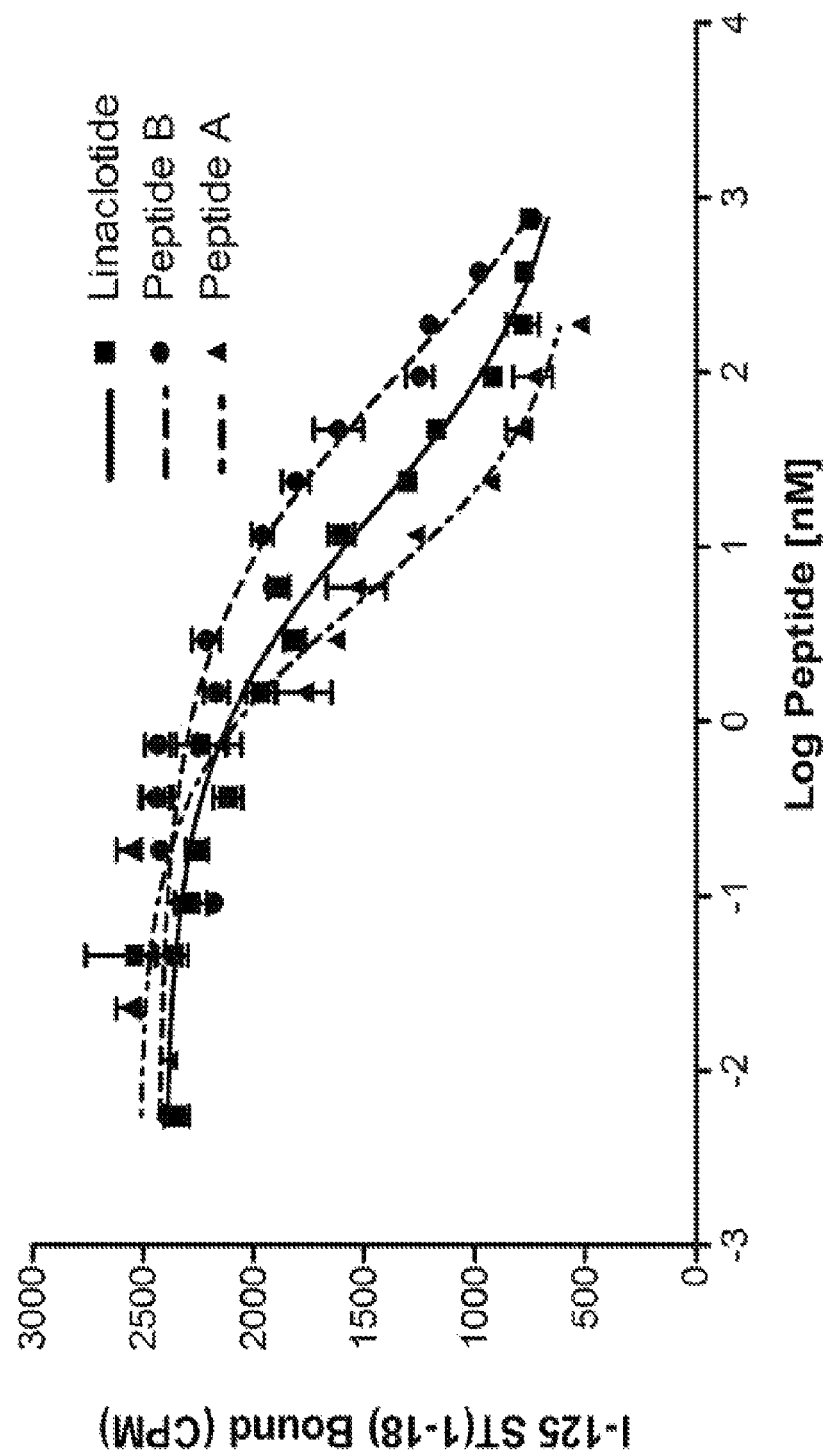

FIG. 21 is a comparative plot of the results of an 1-125 binding assay.

Figure 22:
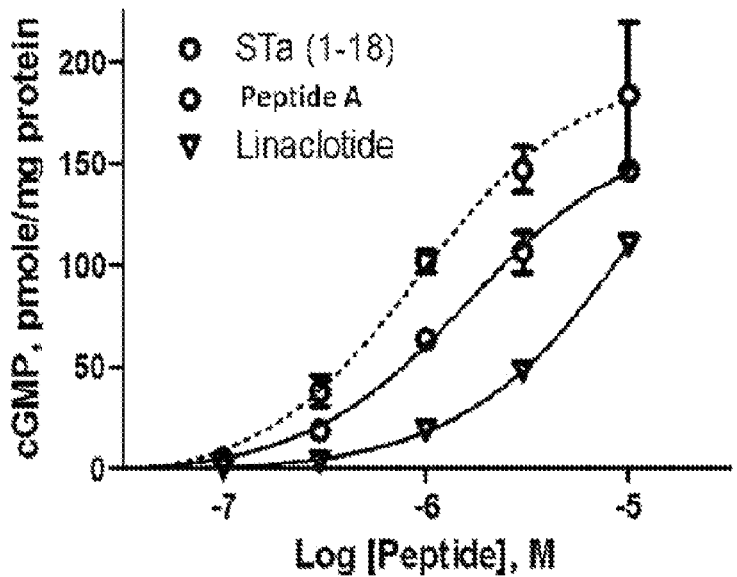

FIG. 22 is a comparative plot of the results of a cGMP accumulation assay.

Figure 23:
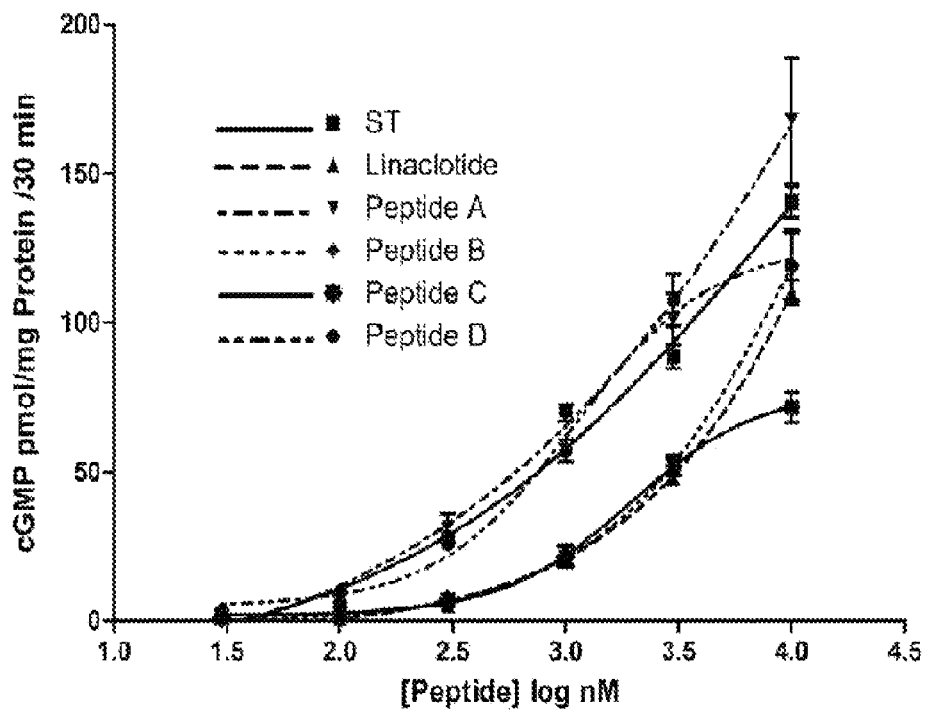

FIG. 23 is a comparative plot of the results of a cGMP accumulation assay.

Figure 24:
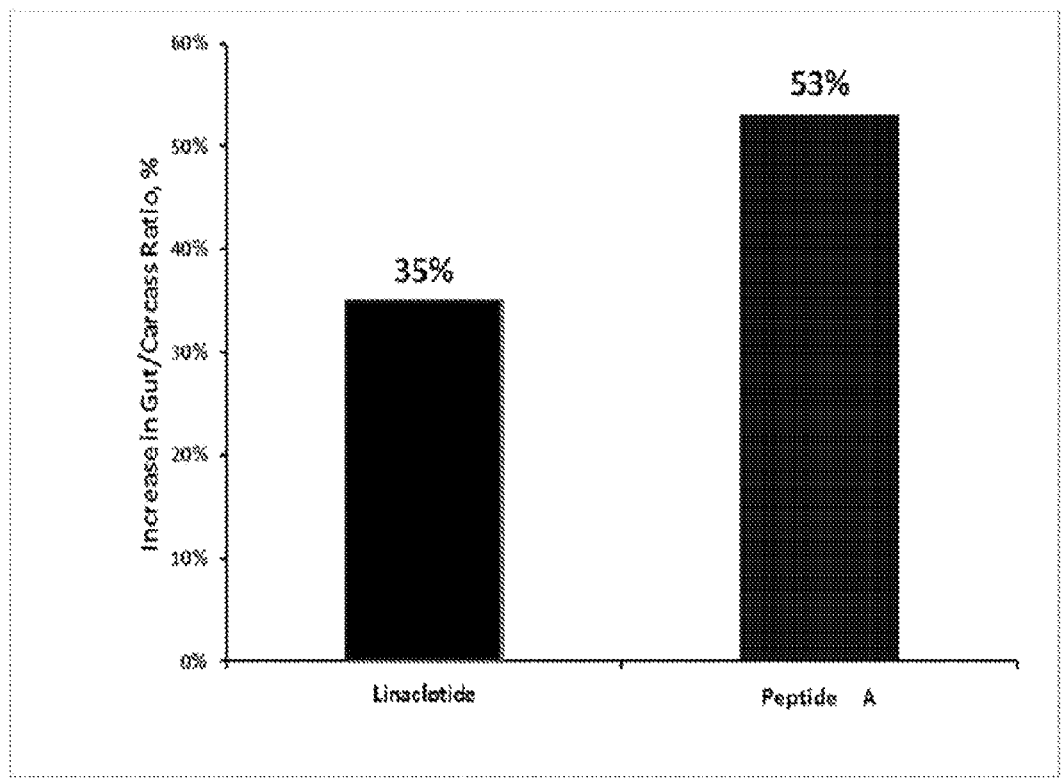

FIG. 24 is a comparative plot of the results of a mouse intestinal secretion assay.

Figure 25:
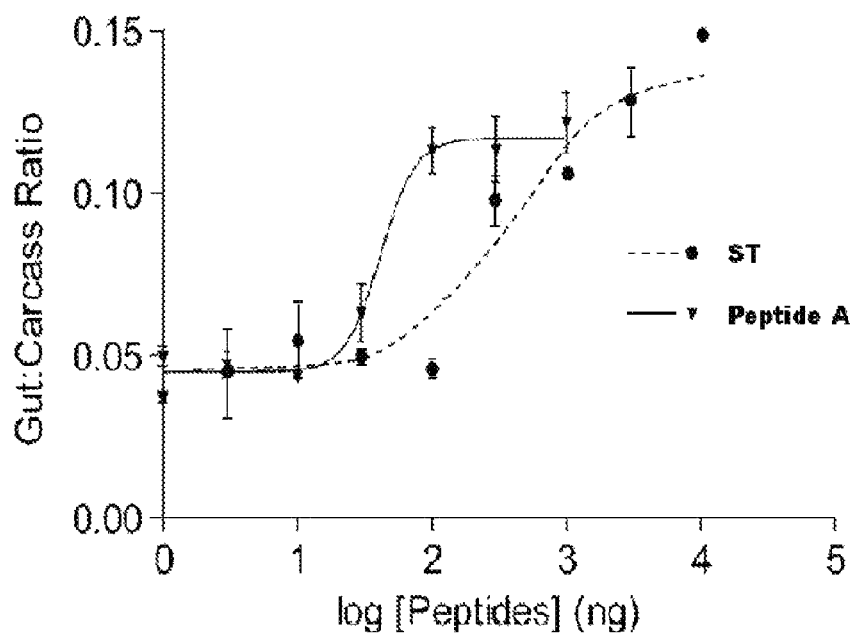

FIG. 25 is a comparative plot of the results of a mouse intestinal secretion assay.

Figure 26:
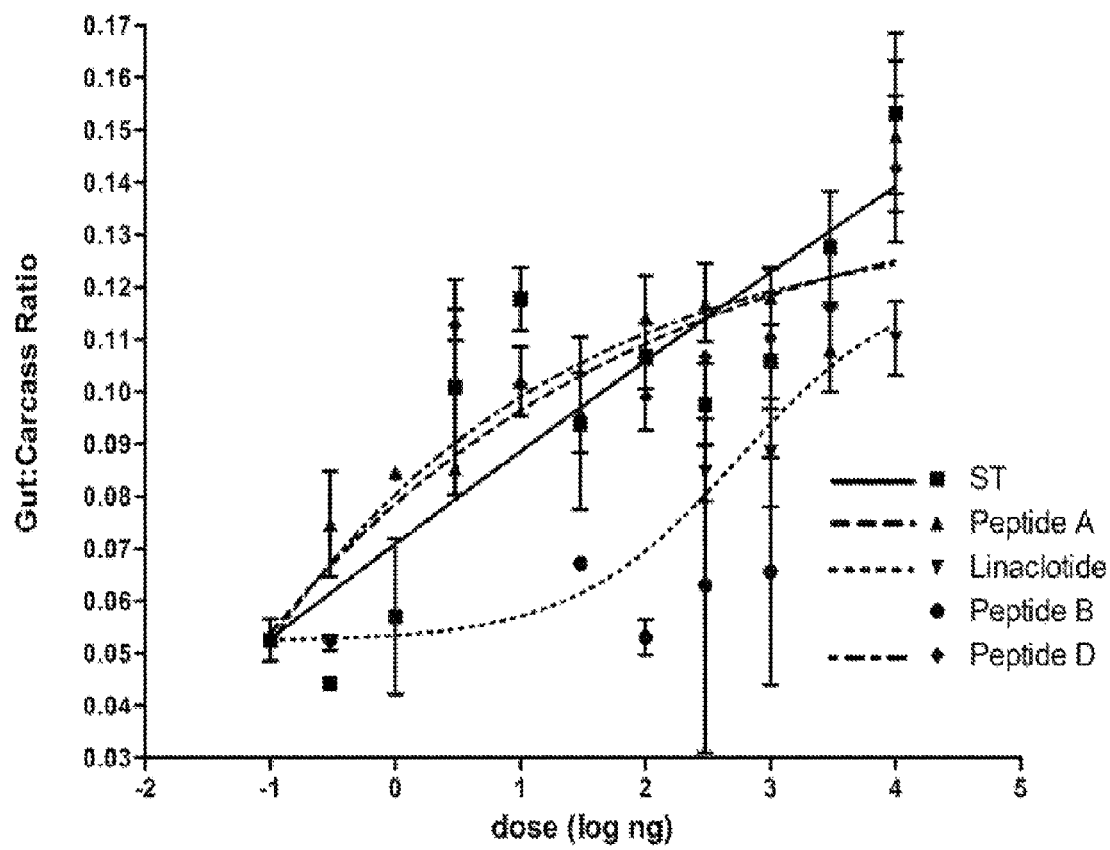
Figure 27:
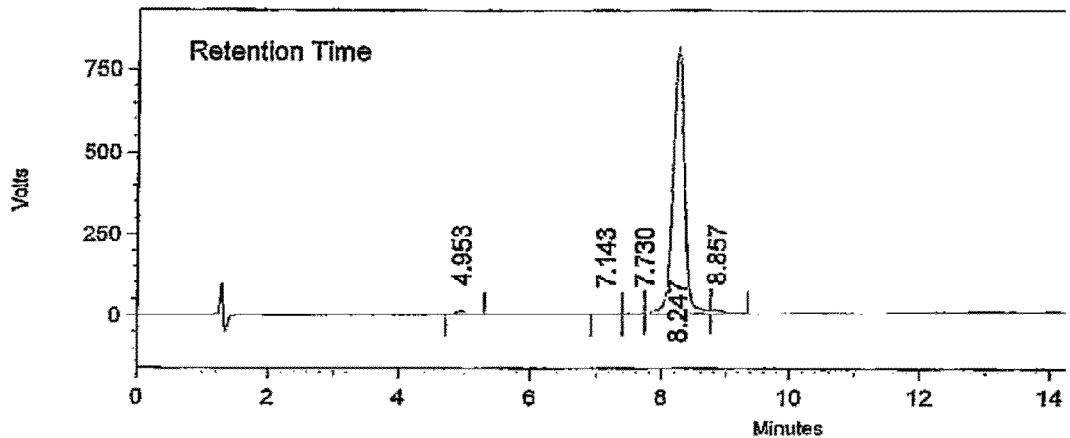

FIG. 26 is a comparative plot of the results of a mouse intestinal secretion assay FIG. 27 is an HPLC chromatogram of purified peptide A (SEQ ID NO: 60).

Figure 28:
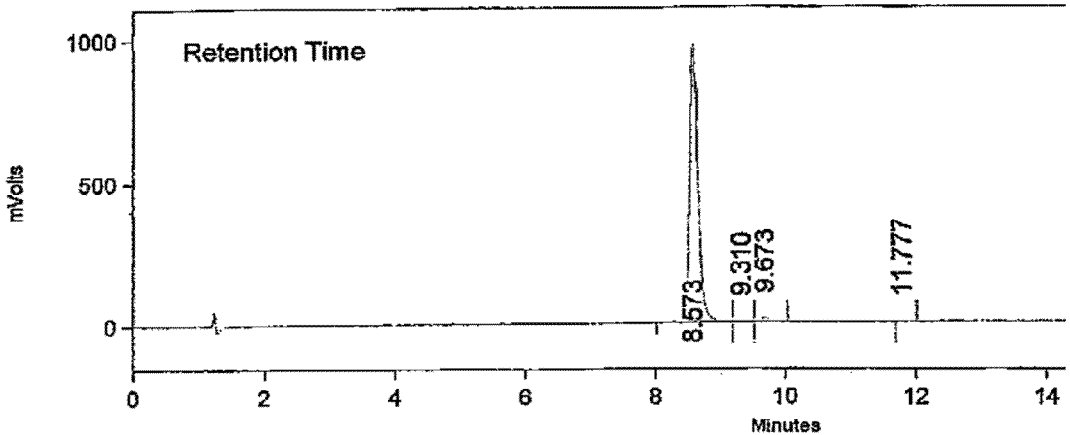

FIG. 28 is an HPLC chromatogram of purified peptide B (SEQ 1D NO: 61).

Figure 29:
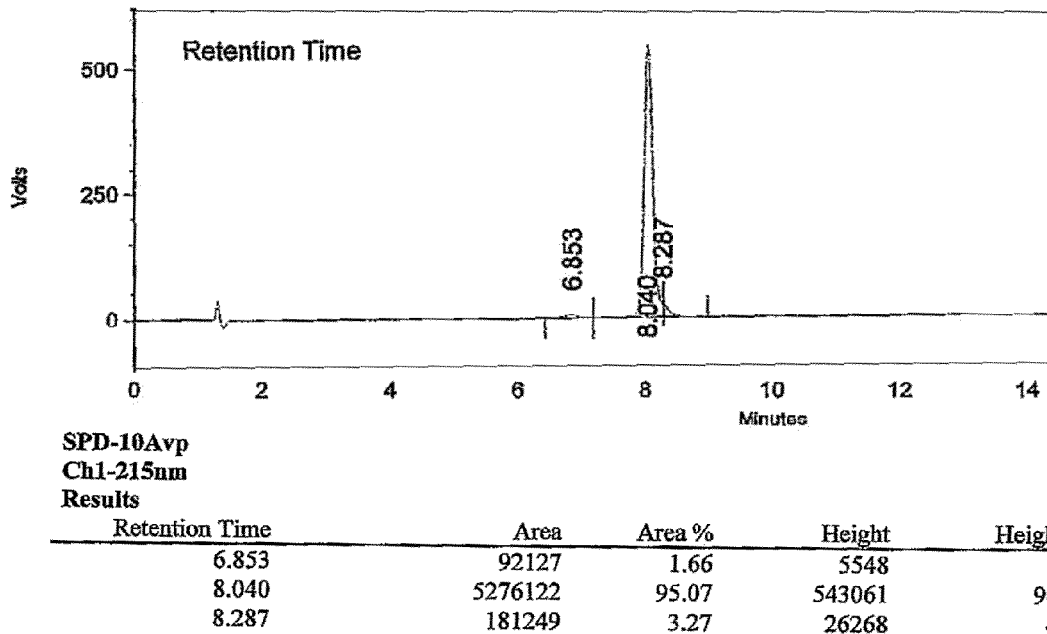

FIG. 29 is an HPLC chromatogram of purified peptide C (SEQ 1D NO: 62).

Figure 30:
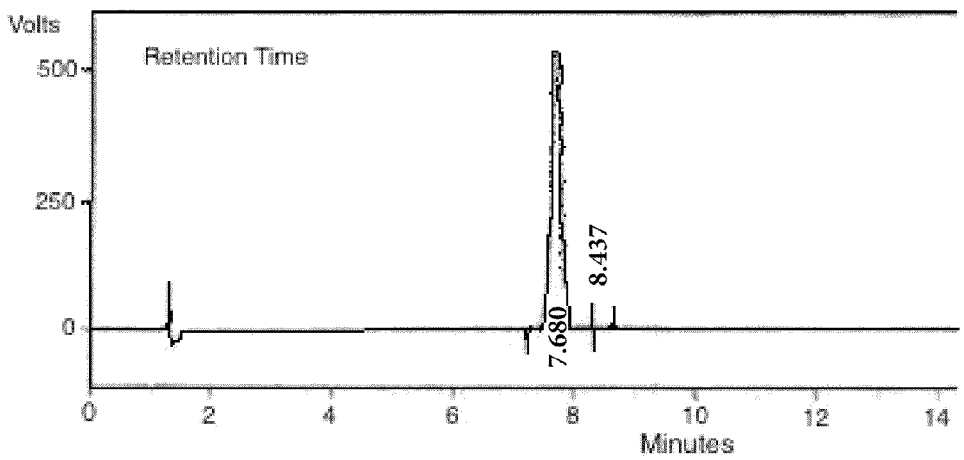

FIG. 30 is an HPLC chromatogram of purified peptide D (SEQ ID NO: 63).

DETAILED DESCRIPTION OF THE INVENTION

Terminology

As used herein, the following terms shall have the following meanings:

As used herein, the terms "antagonist", "antagonist compounds," "antagonists of the invention" are meant to refer to compounds which bind to GCC and block GCC binding to natural ligands but do not activate the GCC pathway.

As used herein, the terms "agonist," "agonist compounds," "agonists of the invention" are meant to refer to compounds which bind to GCC and block GCC binding to natural ligands and activate the GCC pathway.

As used herein, the term "natural ligands" is meant to refer to the methanol-soluble, heat stable enterotoxins as well as the endogenously produced GCC ligands guanylin and uroguanylin.

As used herein, the term "standard amino acids" means the naturally occurring 20 amino acids commonly incorporated into mammalian proteins. These 20 standard amino acids are the L-isomers of the naturally occurring amino acids, glycine, alanine, valine, leucine, isoleucine, serine, methionine, threonine, phenylalanine, tyrosine, tryptophan, cysteine, proline, histidine, aspartic acid, asparagine, glutamic acid, glutamine, carboxyglutamic acid, arginine, ornithine and lysine. Unless specifically indicated, all amino acids referred to in this application are in the L-form.

As used herein, the term "modified amino acid" (or the terms "non-natural amino acid", or "synthetic" or "unnatural" or "non-naturally occurring" amino acid) means any amino acids other than the 20 standard amino acids listed above. In addition to the 20 standard amino acids, there are many other amino acids; these can be naturally occurring or non-natural amino acids. Some of these can be found naturally incorporated into proteins, e.g. after post-translational modification, or not (non-protein amino acids); further, they may be derived by chemical or metabolic modification of any of the standard amino acids or synthesized de novo by entirely artificial means.

Examples of naturally occurring non-standard, modified amino acids sometimes found in natural proteins are selenocysteine, pyrrolysine, hydroxyproline, selenomethionine, ornithine, taurine; examples of naturally occurring but non-protein (i.e. not usually found incorporated into natural proteins) non-standard modified amino acids are carnitine, gamma-aminobutyric acid, hypusine, L-DOPA (L-3,4-dihydroxyphenylalanine), lanthionine, 2-aminoisobutyric acid, dehydroalanine, citrulline, beta alanine (3-aminopropanoic acid). Examples of many other non-natural non-standard amino acids are given below.

As used herein, the term "derivatized amino acid" describes a native amino acid which has been chemically modified. A non-limiting example is penicillamine. There are many other non-standard amino acids—natural, derivatized or synthetic—many of which have been described in the literature (Hunt, 1985; Schultz et al., 2002; Cho et al., 2006; Konno, 2007; Muir, 2009; Alfonta et al., 2010; Currie et al., 2006; 2009; Shailubhai, 2010; Shailubhai & Jacobs, 2010; Shailubhai & Comiskey 2010-US20100221329).

As used herein, the term "treatment" refers to modifying, reducing, alleviating or eliminating symptoms in a subject, as well as preventing symptoms from occurring, worsening or progressing.

As used herein, "efficacy" of a treatment can be measured as an improvement in one or more measurements such as morbidity, mortality, symptoms severity, numbers of symptoms, or control or prevention of a disease.

As used herein, a methylated amino acid is any non-standard amino acid containing one or more methyl groups.

As used herein, the term "pegylated amino acid" shall mean any amino acid, standard or modified, that is covalently linked to one or more units of polyethylene glycol of various length (e.g. PEG 400 or PEG600) or other glycols that are liquid or solid at room temperature, or other polymeric stabilizers.

As used herein, the term "amino acid mimetic (isostere)" means an organic molecule which approximates the steric and electronic configuration of the amino acid it is intended to replace. A non-limiting example is Norleucine.

As used herein, the term "guanylate cyclase C (GCC)" is used to describe the class of guanylate cyclase C receptor on any cell type or tissue to which the agonist peptides analogues or natural agonists described herein bind. The term "intestinal guanylate cyclase receptor" as used herein describes receptors found exclusively on epithelial cells lining the intestinal mucosa. There may also be different receptors to which these agonists bind, and the receptors described herein therefore include any such receptors found on cells, tissue, or the intestinal mucosa.

As used herein, the term "GC agonist" or "GC receptor agonist" is used to describe peptides or compounds that bind to Guanylate Cyclases. The term "GCC agonist" or "GCC receptor agonist" is used to describe peptides or compounds that bind to Guanylate Cyclase C receptors, including those found on the intestinal mucosa. Such peptides may stimulate electrolyte and fluid transport. In the gastrointestinal tract they stimulate electrolyte and water secretion into the intestine. The terms as used herein also covers fragments or prepeptides that bind to the receptors and stimulate electrolyte and fluid secretion. The term "GCC peptide" is used to describe a peptide of the invention that binds to the Guanylate Cyclase C receptor and acts as either an agonist or antagonist.

As used herein, the term "CIC" means Chronic Idiopathic Constipation.

As used herein, the term "IBS" means Irritable Bowel Syndrome, IBS-c means constipation dominant IBS, IBS-d means diarrhea dominant IBS, and IBM-m means mixed constipation and diarrhea dominant IBS. IBS may also mean pain-predominant IBS or post-infectious IBS (IBS-PI).

As used herein, the term "peptide" does not imply a molecule of particular length. In some embodiments the peptides can be between 5 and 30 amino acids in length.

The ST peptides analogues described herein bind the guanylate cyclase C receptor and stimulate intracellular production of cyclic guanosine monophosphate (cGMP). Their binding to the GCC receptor may also induce apoptosis. The ST peptide analogues may exhibit stronger binding to the GCC receptor, stimulate higher intracellular cGMP production, and stimulate more intestinal fluid production than naturally occurring GC-C agonists such as Uroguanylin, Guanylin and ST peptides. For example, the ST peptide analogues of the invention stimulate production of between 10% and 100%, or more, intracellular cGMP, as well as receptor binding or intestinal fluid production, compared to naturally occurring GC-C agonists. The peptide analogues described herein may also be more soluble than naturally occurring peptides, and more stable. The latter maybe be because the peptides described here are in some instances more slowly degraded by reductases and proteases compared to naturally occurring GCC agonists, for example between 1% and 100%, or more, than naturally occurring peptides.

The term "ST peptide analogues" used herein can describe polymers of L-amino acids, D-amino acids, non-naturally occurring amino acids, a derivatized amino acid or an amino acid mimetic, or a combination of all of these. In some embodiments, the peptides can be "retroinverso" peptides, where the direction of the sequence is reversed and the chirality of each amino acid residue is inverted (Jameson et al., 1994; Jameson & Dodson, 1994). Unless otherwise stated, it is assumed that any given L-amino acid sequence (including non-naturally occurring L-amino acid derivatives in the sequence) may be made into a D-retroinverso peptide by synthesizing a reverse of the sequence for the corresponding native L-amino acid sequence, and vice versa for D-amino acid sequences. The reverse synthesis as described here will result in a peptide where the position of the side-chain groups at each alpha carbon is preserved through the exchange of the positions of the carbonyl and the amino groups in each amide bond.

In the formulas as described herein, Xaa is any natural or unnatural, L or D amino acid or amino acid analogue. The use of D-amino acids in synthetic peptide analogues has been described in a number of publications (Konno, 2007). Non-natural amino acids include a number of different amino acid derivatives that have been described (Muir & Abelson, 2009). The cysteine and disulphide bonds in the peptide can be modified as described in a number of different publications (Gariepy et al., 1987; Shimonishi et al., 1987; Hikada et al., 1988; Yamasaki et al., 1988; Hidaka et al., 1991; Yamanaka et al., 1998)

The amino acids in ST peptides can be replaced by a naturally or non-naturally occurring L- or D-amino acid analog. There are numerous amino acids beyond the standard 20 amino acids commonly found in human proteins (Ala, Arg, Asn, Asp, Cys, Gln, Glu, Gly, H is, Ile, Leu, Lys, Met, Phe, Pro, Ser, Thr, Trp, Tyr, and Val) (Hunt, 1985). Any amino acid can be substituted by the D-form of the amino acid. To improve the activity of the ST peptide pharmacophore, substitutions with non-naturally occurring amino acids offer the potential to enhance potency, stability and/or solubility.

Therapeutic Uses of the Compounds

Among the specific conditions that can be treated or prevented are gastrointestinal disorders, blood disorders, cancer, cardiac disorders, endocrine disorders, eye disorders, inflammatory disorders, liver disorders, lung disorders, oral and throat disorders, prostate disorders, skin disorders and obesity. Gastrointestinal disorders include for example dyspepsia; nonulcer dyspepsia; functional dyspepsia; chronic intestinal pseudo-obstruction; colonic pseudo-obstruction; duodenogastric reflux; gastroparesis; gastroesophageal reflux disease; ileus inflammation; post-operative ileus; heartburn (i.e. high acidity in the GI tract); functional heartburn; constipation, e.g., constipation associated with use of medications such as opioids, osteoarthritis drugs, osteoporosis drugs; post-surgical constipation, constipation associated with neuropathic disorders; Crohn's disease; Ulcerative colitis; irritable bowel syndrome (IBS), e.g., constipation predominant-IBS, diarrhea predominant-IBS, and/or mixed/alternating-IBS. Cardiac disorders include for example, congestive heart failure; high cholesterol; high tryglycerides; trachea cardia hypertension. Cancer includes tissue and organ carcinogenesis including metastases such as blood cancer, e.g. myeloma or leukemia; eye cancer; gastrointestinal cancer, e.g., gastric cancer, esophageal cancer, pancreatic cancer, colorectal cancer, intestinal cancer, anal cancer, liver cancer, gallbladder cancer, or colon cancer; liver cancer; lung cancer;

oral cancer; skin cancer, e.g., melanoma; thyroid cancer; prostate cancer; urinary tract cancer, e.g. bladder cancer or kidney cancer. Endocrine disorders include for example cystic fibrosis; diabetes mellitus; hyperthyroidism; hypothyroidism. Eye disorders include for example dry eyes; retinal degeneration; disorders of tear glands; eye inflammation; dry eye syndrome; increased intra-ocular pressure; glaucoma; age-related macular degeneration. Inflammatory disorders include tissue and organ inflammation; lung inflammation, e.g., bronchitis or asthma; kidney inflammation, e.g., nephritis; gastrointestinal system inflammation, e.g., Crohn's disease and ulcerative colitis; necrotizing enterocolitis (NEC); pancreatic inflammation such as pancreatitis; skin inflammation (e.g., psoriasis, eczema). Kidney disorders include for example kidney cancer; kidney failure; nephritis; reflux neuropathy. Liver disorders include for example cirrhosis; fibrosis; Improvement of liver regeneration in liver transplant patients. Lung disorders include for example asthma; chronic obstructive pulmonary disease (COPD); cibrosis; cronchitis; cystic fibrosis; emphysema. Oral disorders include for example dry mouth, e.g. xerostomia; Sjogren's syndrome; salivary gland disorder, e.g. salivary gland duct blockage or malfunction; gum diseases, e.g., periodontal disease. Prostate disorders include for example benign prostatic hyperplasia (BPH); prostate cancer. Skin disorders include for example dry skin; xerosis; melanoma; psoriasis. Some compounds of the invention are useful to prevent or treat cancer (as conjugates or adjuvants to active agents), particularly metastasized colorectal cancer and primary and metastasized esophageal and stomach cancer, as well as prevent metastasis and activate the GCC pathway to induce defecation such when an individual is constipated or impacted. Some aspects of the present invention relate to these compounds and to methods of using them.

There are two compounds of the GCC agonist class that that are in clinical development at the time of the submission of this invention, linaclotide and plecanatide. Plecanatide is a Uroguanylin peptide with the sequence

```
SEQ ID NO: 39:
Asn Asp Glu Cys Glu Leu Cys Val Asn Val Ala Cys

Thr Gly Cys Leu
```

Linaclotide is an ST peptide analogue compound with the sequence

```
SEQ ID NO: 40:
Cys Cys Glu Tyr Cys Cys Asn Pro Ala Cys Thr Gly

Cys Tyr
```

A common reference peptide used in this specification is the E. coli STa peptide:

```
SEQ ID NO: 28:
Asn Thr Phe Tyr Cys Cys Glu Leu Cys Cys Asn Pro

Ala Cys Ala Gly Cys Tyr
```

The agonists described here are analogs of ST peptide and have superior properties such as higher potency for stimulating the GCC receptor and cGMP production than native naturally occurring ST peptides. They are also significantly more potent that Uroguanylin or Guanylin or analogues of Uroguanylin or Guanylin. They may also have high resistance to degradation by reductases present in tissues and in the intestine. The primary step for the degradation of ST peptides and reduction of their activity is reduction of the disulphide bonds by reductases (Currie et al., 1992; Okamoto et al., 1995; Hasegawa et al., 1999; Batisson et al., 2000; Kessler et al., 2008; Kessler et al., 2009).

Composition of Compounds in the Invention

The present invention relates to compositions and uses of compounds having a structure according to formula:

```
SEQ ID NO: 41:
H2N-Cys(1)-Cys(2)-Xaa(3)-Xaa(4)-Cys(5)-Cys(6)-

Xaa(7)-Xaa(8)-Xaa(9)-Cys(10)-Xaa(11)-Xaa(12)-

Cys(13)-COOH
```

Where Xaa can be several different amino acids. The numbers in parenthesis refer to the amino acids position in the peptide, starting from the N-terminus. The peptide has disulphide bonds between Cys(1) and Cys(6), Cys(2) and Cys(10), and between Cys(5) and Cys(13).

In one embodiment, the present invention relates to the composition and uses of compounds having a structure according to formula:

```
SEQ ID NO: 53:
H2N-X(1)-Cys(2)-Glu(3)-Z(4)-Cys(5)-Cys(6)-Asn(7)-

Pro(8)-Ala(9)-Cys(10)-Ala(11)-Gly(12)-Cys(13)-COOH
``` where X is D or L-Cysteine, or D or L-Penicillamine, and where Z is L-Leucine, L-NorLeucine, or L-Threonine. The numbers in parenthesis refers to the amino acids position in the peptide, starting from the N-terminus. The peptide has disulphide bonds between X(1) and Cys(6), Cys(2) and Cys (10), and between Cys(5) and Cys(13).

The structure is embodied by several non-limiting examples:

```
SEQ ID NO: 42:
L-Cys-Cys-Glu-L-Thr-Cys-Cys-Asn-Pro-Ala-Cys-Ala-

Gly-Cys

SEQ ID NO: 43:
L-Cys-Cys-Glu-L-norLeu-Cys-Cys-Asn-Pro-Ala-Cys-

Ala-Gly-Cys

SEQ ID NO: 44:
D-Cys-Cys-Glu-L-Thr-Cys-Cys-Asn-Pro-Ala-Cys-Ala-

Gly-Cys

SEQ ID NO: 45:
D-Cys-Cys-Glu-L-Leu-Cys-Cys-Asn-Pro-Ala-Cys-Ala-

Gly-Cys

SEQ ID NO: 46:
D-Cys-Cys-Glu-L-norLeu-Cys-Cys-Asn-Pro-Ala-Cys-

Ala-Gly-Cys

SEQ ID NO: 47:
D-Pen-Cys-Glu-L-Thr-Cys-Cys-Asn-Pro-Ala-Cys-Ala-

Gly-Cys

SEQ ID NO: 48:
D-Pen-Cys-Glu-L-Leu-Cys-Cys-Asn-Pro-Ala-Cys-Ala-

Gly-Cys
```

-continued

SEQ ID NO: 49:
D-Pen-Cys-Glu-L-norLeu-Cys-Cys-Asn-Pro-Ala-Cys-
Ala-Gly-Cys

SEQ ID NO: 50:
L-Pen-Cys-Glu-L-Thr-Cys-Cys-Asn-Pro-Ala-Cys-Ala-
Gly-Cys

SEQ ID NO: 51:
L-Pen-Cys-Glu-L-Leu-Cys-Cys-Asn-Pro-Ala-Cys-Ala-
Gly-Cys

SEQ ID NO: 52:
L-Pen-Cys-Glu-L-norLeu-Cys-Cys-Asn-Pro-Ala-Cys-
Ala-Gly-Cys

In one embodiment, the present invention provides a peptide comprising the sequence X-Cys-Glu-Z-Cys-Cys-Asn-Pro-Ala-Cys-Ala-Gly-Cys (SEQ ID NO: 53), where X is D or L-Cysteine, or D or L-Penicillamine, and where Z is L-Leucine, L-NorLeucine, or L-Threonine. The present invention also contemplates pharmaceutical compositions comprising these peptides. The present invention also contemplates methods of treating a gastrointestinal disease, comprising administering these peptides.

In one embodiment, the present invention provides a method of treating constipation and irritable bowel syndrome, comprising administering a peptide comprising the sequence X-Cys-Glu-Z-Cys-Cys-Asn-Pro-Ala-Cys-Ala-Gly-Cys (SEQ ID NO: 53), where X is D or L-Cysteine, or D or L-Penicillamine, and where Z is L-Leucine, L-NorLeucine, or L-Threonine. In another embodiment, the present invention provides a method of treating constipation and irritable bowel syndrome, comprising administering a peptide consisting of the sequence X-Cys-Glu-Z-Cys-Cys-Asn-Pro-Ala-Cys-Ala-Gly-Cys (SEQ ID NO: 53), where X is D or L-Cysteine, or D or L-Penicillamine, and where Z is L-Leucine, L-NorLeucine, or L-Threonine.

Scheme 1 shows the peptide sequences of the invention and the location of residues that may be modified, and exemplary modifications that may be made at each residue.

TABLE 2

| Abbreviations used in Scheme 1 | |
|---|---|
| Pen = | Penicillamine |
| hSer = | Homoserine, Hse |
| Csa = | Cysteic Acid |
| hLeu = | Homoleucine, Hle |
| norLeu = | Norleucine, Nle |
| ChxAla = | Cyclohexyl-Aalanine, Cha |
| ChxIle = | Cyclohexyl-Isoleucine, Chi |
| Dopa = | L-Dopamine, L-dihydroxyphenylalanine |
| Dhp = | 3,4,-dihydro-Proline, D-Pro 3,4-Dehydroproline |
| Thz = | Thiazolidine (4-thiazolidine-2-carboxylic acid), Tzd |
| HyPro = | Hydroxy-Proline, Hyp, Hydroxyproline |
| Pip = | L-Pipecolic Acid |
| 4F-Phe = | 4-fluoro-Phenylalanine, Phe(4-F), 4-fluorophenylalanine |
| 4MeO-Phe = | 4-methoxy-Phenylalanine, Phe(4-OMe), 4-methoxyphenylalanine |
| 4NO2-Phe = | 4-nitro-Phenylalanine, Phe(4-NO2), 4-Nitrophenylalanine |
| 5F-Phe = | Pentafluoro-Phenylalanine, Phe(3-F), 3-fluorophenylalanine |
| 4MeF3-Phe = | Phe(4-MeF3), 4-trifluoromethyl-phenylalanine |
| NMe-Leu = | N-methyl-leucine, MeLeu, N-Methylleucine |
| D-Ala = | D-Alanine |
| Mpr = | 3-mercaptoproprionic acid |
| □ = | None (or deletion) |
| natural amino acids | (L-amino acids unless otherwise stated) |
| Alanine = | Ala |
| Arginine = | Arg |
| Asparagine = | Asn |
| Aspartic acid = | Asp |
| Cysteine = | Cys |
| Glutamic acid = | Glu |
| Glutamine = | Gln |
| Glycine = | Gly |
| Histidine = | His |
| Isoleucine = | Ile |
| Leucine = | Leu |
| Lysine = | Lys |
| Methionine = | Met |
| Phenylalanine = | Phe |
| Proline = | Pro |

SCHEME 1

| | | | | | | | | | position-no.: | | | | | | | | | |
|---|---|---|---|---|---|---|---|---|---|---|---|---|---|---|---|---|---|---|
| 1 | 2 | 3 | 4 | 5 | 6 | 7 | 8 | 9 | 10 | 11 | 12 | 13 | 14 | 15 | 16 | 17 | 18 | 19 |
| | | | | | | | | | Natural sequence: | | | | | | | | | |
| Asn | Thr | Phe | Tyr | Cys | Cys | Glu | Leu | Cys | Cys | Asn | Pro | Ala | Cys | Ala | Gly | Cys | Tyr | Tyr |

| Substitutions: | | | | | | | | | | | | | | | | | | |
|---|---|---|---|---|---|---|---|---|---|---|---|---|---|---|---|---|---|---|
| Ser | Ser | Tyr | Phe | Pen | Pen | Ser | Thr | Pen | Pen | | Dhp | | Pen | Thr | D-Ala | Pen | | |
| Thr | Asn | | | Trp | Mpr | hSer | hLeu | | | | Thz | | | Ser | | | Phe | Phe |
| | | | | | | Csa | norLeu | | | | HyPro | | | 4F-Phe | | | Ile | Ile |
| | | | | | | | ChxAla | | | | Pip | | | 4MeO-Phe | | | Trp | Trp |
| | | | | | | | ChxIle | | | | | | | 4NO2-Phe | | | | |
| | | | | | | | Phe | | | | Ala | | | 5F-Phe | | | | |
| | | | | | | | Tyr | | | | | | | 4MeF3-Phe | | | | |
| | | | | | | | Dopa | | | | | | | | | | | |
| | | | | | | | NMe-Leu | | | | | | | | | | | |

TABLE 2-continued

Abbreviations used in Scheme 1

| | |
|---|---|
| Serine = | Ser |
| Threonine = | Thr |
| Tryptophan = | Try |
| Tyrosine = | Tyr |
| Valine = | Val |

Additional embodiments include but are not limited to those shown in the following Tables 3A, 3B, and 3C, showing single, double and triple substitutions that may be used in the practice of the invention. The embodiments shown in the tables are shown without the first four amino acids on the N-terminal and the C-terminal residue (i.e. residues 1-4 and 19 were left off). The amino acids shown in scheme 1 may be optionally included at these positions on the sequences shown in the tables. In one embodiment, a peptide may have the sequence Asn Thr Phe Tyr Cys Cys Glu Thr Cys Cys Asn HyPro Ala Cys Ala Gly Cys Tyr Tyr (SEQ ID NO: 59). In another embodiment the peptide may have one of the following sequences:

```
SEQ ID NO: 60 (Peptide A):
H2N Cys Cys Glu Leu Cys Cys Asn Dhp Ala Cys Ala

Gly Cys Tyr COOH

SEQ ID NO: 61 (Peptide B):
H2N Cys Cys Glu L-Thr Cys Cys Asn Pro Ala Cys Ala

Gly Cys Tyr COOH

SEQ ID NO: 62 (Peptide C):
H2N Cys Cys Glu Leu Cys Cys Asn HyPro Ala Cys Ala

Gly Cys Tyr COOH

SEQ ID NO: 63 (Peptide D):
H2N Cys Cys Glu Leu Cys Cys Asn Thz Ala Cys Ala

Gly Cys Tyr COOH
```

In another embodiment, a peptide may have the sequence

```
SEQ ID NO: 64:
Cys Cys Glu Thr Cys Cys Asn HyPro Ala Cys Ala Gly

Cys Tyr.
```

In another embodiment, a peptide may have the sequence

```
SEQ ID NO: 65:
Asn Thr Phe Tyr Cys Cys Glu Leu Cys Cys Asn Dhp

Ala Cys Ala Gly Cys Tyr

SEQ ID NO: 66:
Asn Thr Phe Tyr Cys Cys Glu L-Thr Cys Cys Asn Pro

Ala Cys Ala Gly Cys Tyr

SEQ ID NO: 67:
Asn Thr Phe Tyr Cys Cys Glu Leu Cys Cys Asn HyPro

Ala Cys Ala Gly Cys Tyr

SEQ ID NO: 68:
Asn Thr Phe Tyr Cys Cys Glu Leu Cys Cys Asn Thz

Ala Cys Ala Gly Cys Tyr

SEQ ID NO: 69:
Asn Thr Phe Tyr Cys Cys Glu Thr Cys Cys Asn HyPro

Ala Cys Ala Gly Cys Tyr
```

TABLE 3A

Single substitutions from Scheme 1, including N-terminal tail

| | |
|---|---|
| SEQ ID NO: 100 | Cys Cys Glu Leu Cys Cys Asn Pro Ala Cys Ala Gly Cys Tyr |
| SEQ ID NO: 101 | Mpr Cys Glu Leu Cys Cys Asn Pro Ala Cys Ala Gly Cys Tyr |
| SEQ ID NO: 102 | Cys Cys Ser Leu Cys Cys Asn Pro Ala Cys Ala Gly Cys Tyr |
| SEQ ID NO: 103 | Cys Cys hSer Leu Cys Cys Asn Pro Ala Cys Ala Gly Cys Tyr |
| SEQ ID NO: 104 | Cys Cys Csa Leu Cys Cys Asn Pro Ala Cys Ala Gly Cys Tyr |
| SEQ ID NO: 61 | Cys Cys Glu Thr Cys Cys Asn Pro Ala Cys Ala Gly Cys Tyr |
| SEQ ID NO: 105 | Cys Cys Glu hLeu Cys Cys Asn Pro Ala Cys Ala Gly Cys Tyr |
| SEQ ID NO: 106 | Cys Cys Glu norLeu Cys Cys Asn Pro Ala Cys Ala Gly Cys Tyr |
| SEQ ID NO: 107 | Cys Cys Glu ChxAla Cys Cys Asn Pro Ala Cys Ala Gly Cys Tyr |
| SEQ ID NO: 108 | Cys Cys Glu ChxIle Cys Cys Asn Pro Ala Cys Ala Gly Cys Tyr |
| SEQ ID NO: 109 | Cys Cys Glu Phe Cys Cys Asn Pro Ala Cys Ala Gly Cys Tyr |
| SEQ ID NO: 110 | Cys Cys Glu Tyr Cys Cys Asn Pro Ala Cys Ala Gly Cys Tyr |
| SEQ ID NO: 111 | Cys Cys Glu Dopa Cys Cys Asn Pro Ala Cys Ala Gly Cys Tyr |
| SEQ ID NO: 112 | Cys Cys Glu NMe-Leu Cys Cys Asn Pro Ala Cys Ala Gly Cys Tyr |
| SEQ ID NO: 60 | Cys Cys Glu Leu Cys Cys Asn Dhp Ala Cys Ala Gly Cys Tyr |
| SEQ ID NO: 63 | Cys Cys Glu Leu Cys Cys Asn Thz Ala Cys Ala Gly Cys Tyr |

TABLE 3A-continued

Single substitutions from Scheme 1, including N-terminal tail

| | |
|---|---|
| SEQ ID NO: 62 | Cys Cys Glu Leu Cys Cys Asn HyPro Ala Cys Ala Gly Cys Tyr |
| SEQ ID NO: 113 | Cys Cys Glu Leu Cys Cys Asn Pip Ala Cys Ala Gly Cys Tyr |
| SEQ ID NO: 114 | Cys Cys Glu Leu Cys Cys Asn Ile Ala Cys Ala Gly Cys Tyr |
| SEQ ID NO: 115 | Cys Cys Glu Leu Cys Cys Asn Ala Ala Cys Ala Gly Cys Tyr |
| SEQ ID NO: 116 | Cys Cys Glu Leu Cys Cys Asn Pro Ala Cys Thr Gly Cys Tyr |
| SEQ ID NO: 117 | Cys Cys Glu Leu Cys Cys Asn Pro Ala Cys Ser Gly Cys Tyr |
| SEQ ID NO: 118 | Cys Cys Glu Leu Cys Cys Asn Pro Ala Cys 4F-Phe Gly Cys Tyr |
| SEQ ID NO: 119 | Cys Cys Glu Leu Cys Cys Asn Pro Ala Cys 4MeO-Phe Gly Cys Tyr |
| SEQ ID NO: 120 | Cys Cys Glu Leu Cys Cys Asn Pro Ala Cys 4NO2-Phe Gly Cys Tyr |
| SEQ ID NO: 121 | Cys Cys Glu Leu Cys Cys Asn Pro Ala Cys 5F-Phe Gly Cys Tyr |
| SEQ ID NO: 122 | Cys Cys Glu Leu Cys Cys Asn Pro Ala Cys 4MeF3-Phe Gly Cys Tyr |
| SEQ ID NO: 123 | Cys Cys Glu Leu Cys Cys Asn Pro Ala Cys Ala D-Ala Cys Tyr |
| SEQ ID NO: 124 | Cys Cys Glu Leu Cys Cys Asn Pro Ala Cys Ala Gly Cys Ile |
| SEQ ID NO: 125 | Cys Cys Glu Leu Cys Cys Asn Pro Ala Cys Ala Gly Cys Trp |
| SEQ ID NO: 64 | Cys Cys Glu Thr Cys Cys Asn HyPro Ala Cys Ala Gly Cys Tyr. |
| SEQ ID NO: 150 | Asn Thr Phe Tyr Cys Cys Glu Leu Cys Cys Asn Pro Ala Cys Ala Gly Cys Tyr |
| SEQ ID NO: 151 | Asn Thr Phe Tyr Mpr Cys Glu Leu Cys Cys Asn Pro Ala Cys Ala Gly Cys Tyr |
| SEQ ID NO: 152 | Asn Thr Phe Tyr Cys Cys Ser Leu Cys Cys Asn Pro Ala Cys Ala Gly Cys Tyr |
| SEQ ID NO: 153 | Asn Thr Phe Tyr Cys Cys hSer Leu Cys Cys Asn Pro Ala Cys Ala Gly Cys Tyr |
| SEQ ID NO: 154 | Asn Thr Phe Tyr Cys Cys Csa Leu Cys Cys Asn Pro Ala Cys Ala Gly Cys Tyr |
| SEQ ID NO: 66 | Asn Thr Phe Tyr Cys Cys Glu Thr Cys Cys Asn Pro Ala Cys Ala Gly Cys Tyr |
| SEQ ID NO: 155 | Asn Thr Phe Tyr Cys Cys Glu hLeu Cys Cys Asn Pro Ala Cys Ala Gly Cys Tyr |
| SEQ ID NO: 156 | Asn Thr Phe Tyr Cys Cys Glu norLeu Cys Cys Asn Pro Ala Cys Ala Gly Cys Tyr |
| SEQ ID NO: 157 | Asn Thr Phe Tyr Cys Cys Glu ChxAla Cys Cys Asn Pro Ala Cys Ala Gly Cys Tyr |
| SEQ ID NO: 158 | Asn Thr Phe Tyr Cys Cys Glu ChxIle Cys Cys Asn Pro Ala Cys Ala Gly Cys Tyr |
| SEQ ID NO: 159 | Asn Thr Phe Tyr Cys Cys Glu Phe Cys Cys Asn Pro Ala Cys Ala Gly Cys Tyr |
| SEQ ID NO: 160 | Asn Thr Phe Tyr Cys Cys Glu Tyr Cys Cys Asn Pro Ala Cys Ala Gly Cys Tyr |
| SEQ ID NO: 161 | Asn Thr Phe Tyr Cys Cys Glu Dopa Cys Cys Asn Pro Ala Cys Ala Gly Cys Tyr |
| SEQ ID NO: 162 | Asn Thr Phe Tyr Cys Cys Glu NMe-Leu Cys Cys Asn Pro Ala Cys Ala Gly Cys Tyr |
| SEQ ID NO: 65 | Asn Thr Phe Tyr Cys Cys Glu Leu Cys Cys Asn Dhp Ala Cys Ala Gly Cys Tyr |
| SEQ ID NO: 68 | Asn Thr Phe Tyr Cys Cys Glu Leu Cys Cys Asn Thz Ala Cys Ala Gly Cys Tyr |
| SEQ ID NO: 67 | Asn Thr Phe Tyr Cys Cys Glu Leu Cys Cys Asn HyPro Ala Cys Ala Gly Cys Tyr |
| SEQ ID NO: 163 | Asn Thr Phe Tyr Cys Cys Glu Leu Cys Cys Asn Pip Ala Cys Ala Gly Cys Tyr |
| SEQ ID NO: 164 | Asn Thr Phe Tyr Cys Cys Glu Leu Cys Cys Asn Ile Ala Cys Ala Gly Cys Tyr |
| SEQ ID NO: 165 | Asn Thr Phe Tyr Cys Cys Glu Leu Cys Cys Asn Ala Ala Cys Ala Gly Cys Tyr |
| SEQ ID NO: 166 | Asn Thr Phe Tyr Cys Cys Glu Leu Cys Cys Asn Pro Ala Cys Thr Gly Cys Tyr |
| SEQ ID NO: 167 | Asn Thr Phe Tyr Cys Cys Glu Leu Cys Cys Asn Pro Ala Cys Ser Gly Cys Tyr |
| SEQ ID NO: 168 | Asn Thr Phe Tyr Cys Cys Glu Leu Cys Cys Asn Pro Ala Cys 4F-Phe Gly Cys Tyr |
| SEQ ID NO: 169 | Asn Thr Phe Tyr Cys Cys Glu Leu Cys Cys Asn Pro Ala Cys 4MeO-Phe Gly Cys Tyr |

TABLE 3A-continued

Single substitutions from Scheme 1, including N-terminal tail

| | |
|---|---|
| SEQ ID NO: 170 | Asn Thr Phe Tyr Cys Cys Glu Leu Cys Cys Asn Pro Ala Cys 4NO2-Phe Gly Cys Tyr |
| SEQ ID NO: 171 | Asn Thr Phe Tyr Cys Cys Glu Leu Cys Cys Asn Pro Ala Cys 5F-Phe Gly Cys Tyr |
| SEQ ID NO: 172 | Asn Thr Phe Tyr Cys Cys Glu Leu Cys Cys Asn Pro Ala Cys 4MeF3-Phe Gly Cys Tyr |
| SEQ ID NO: 173 | Asn Thr Phe Tyr Cys Cys Glu Leu Cys Cys Asn Pro Ala Cys Ala D-Ala Cys Tyr |
| SEQ ID NO: 174 | Asn Thr Phe Tyr Cys Cys Glu Leu Cys Cys Asn Pro Ala Cys Ala Gly Cys Ile |
| SEQ ID NO: 175 | Asn Thr Phe Tyr Cys Cys Glu Leu Cys Cys Asn Pro Ala Cys Ala Gly Cys Trp |
| SEQ ID NO: 69 | Asn Thr Phe Tyr Cys Cys Glu Thr Cys Cys Asn HyPro Ala Cys Ala Gly Cys Tyr |

TABLE 3B

Double substitutions from Scheme 1

| | |
|---|---|
| SEQ ID NO: 200 | Pen Cys Glu norLeu Cys Pen Asn Pro Ala Cys Ala Gly Cys Tyr |
| SEQ ID NO: 201 | Mpr Cys Ser Leu Cys Cys Asn Pro Ala Cys Ala Gly Cys Tyr |
| SEQ ID NO: 202 | Mpr Cys hSer Leu Cys Cys Asn Pro Ala Cys Ala Gly Cys Tyr |
| SEQ ID NO: 203 | Mpr Cys Csa Leu Cys Cys Asn Pro Ala Cys Ala Gly Cys Tyr |
| SEQ ID NO: 204 | Mpr Cys Glu Thr Cys Cys Asn Pro Ala Cys Ala Gly Cys Tyr |
| SEQ ID NO: 205 | Mpr Cys Glu hLeu Cys Cys Asn Pro Ala Cys Ala Gly Cys Tyr |
| SEQ ID NO: 206 | Mpr Cys Glu norLeu Cys Cys Asn Pro Ala Cys Ala Gly Cys Tyr |
| SEQ ID NO: 207 | Mpr Cys Glu ChxAla Cys Cys Asn Pro Ala Cys Ala Gly Cys Tyr |
| SEQ ID NO: 208 | Mpr Cys Glu ChxIle Cys Cys Asn Pro Ala Cys Ala Gly Cys Tyr |
| SEQ ID NO: 209 | Mpr Cys Glu Phe Cys Cys Asn Pro Ala Cys Ala Gly Cys Tyr |
| SEQ ID NO: 210 | Mpr Cys Glu Tyr Cys Cys Asn Pro Ala Cys Ala Gly Cys Tyr |
| SEQ ID NO: 211 | Mpr Cys Glu Dopa Cys Cys Asn Pro Ala Cys Ala Gly Cys Tyr |
| SEQ ID NO: 212 | Mpr Cys Glu NMe-Leu Cys Cys Asn Pro Ala Cys Ala Gly Cys Tyr |
| SEQ ID NO: 213 | Mpr Cys Glu Leu Cys Cys Asn Dhp Ala Cys Ala Gly Cys Tyr |
| SEQ ID NO: 214 | Mpr Cys Glu Leu Cys Cys Asn Thz Ala Cys Ala Gly Cys Tyr |
| SEQ ID NO: 215 | Mpr Cys Glu Leu Cys Cys Asn HyPro Ala Cys Ala Gly Cys Tyr |
| SEQ ID NO: 216 | Mpr Cys Glu Leu Cys Cys Asn Pip Ala Cys Ala Gly Cys Tyr |
| SEQ ID NO: 217 | Mpr Cys Glu Leu Cys Cys Asn Ile Ala Cys Ala Gly Cys Tyr |
| SEQ ID NO: 218 | Mpr Cys Glu Leu Cys Cys Asn Ala Ala Cys Ala Gly Cys Tyr |
| SEQ ID NO: 219 | Mpr Cys Glu Leu Cys Cys Asn Pro Ala Cys Thr Gly Cys Tyr |
| SEQ ID NO: 220 | Mpr Cys Glu Leu Cys Cys Asn Pro Ala Cys Ser Gly Cys Tyr |
| SEQ ID NO: 221 | Mpr Cys Glu Leu Cys Cys Asn Pro Ala Cys 4F-Phe Gly Cys Tyr |
| SEQ ID NO: 222 | Mpr Cys Glu Leu Cys Cys Asn Pro Ala Cys 4MeO-Phe Gly Cys Tyr |
| SEQ ID NO: 223 | Mpr Cys Glu Leu Cys Cys Asn Pro Ala Cys 4NO2-Phe Gly Cys Tyr |
| SEQ ID NO: 224 | Mpr Cys Glu Leu Cys Cys Asn Pro Ala Cys 5F-Phe Gly Cys Tyr |
| SEQ ID NO: 225 | Mpr Cys Glu Leu Cys Cys Asn Pro Ala Cys 4MeF3-Phe Gly Cys Tyr |
| SEQ ID NO: 226 | Mpr Cys Glu Leu Cys Cys Asn Pro Ala Cys Ala D-Ala Cys Tyr |
| SEQ ID NO: 227 | Mpr Cys Glu Leu Cys Cys Asn Pro Ala Cys Ala Gly Cys Ile |

TABLE 3B-continued

| Double substitutions from Scheme 1 |
| --- |

SEQ ID NO: 228  Mpr Cys Glu Leu Cys Cys Asn Pro Ala Cys Ala Gly Cys Trp

SEQ ID NO: 229  Cys Cys Ser Thr Cys Cys Asn Pro Ala Cys Ala Gly Cys Tyr

SEQ ID NO: 230  Cys Cys Ser hLeu Cys Cys Asn Pro Ala Cys Ala Gly Cys Tyr

SEQ ID NO: 231  Cys Cys Ser norLeu Cys Cys Asn Pro Ala Cys Ala Gly Cys Tyr

SEQ ID NO: 232  Cys Cys Ser ChxAla Cys Cys Asn Pro Ala Cys Ala Gly Cys Tyr

SEQ ID NO: 233  Cys Cys Ser ChxIle Cys Cys Asn Pro Ala Cys Ala Gly Cys Tyr

SEQ ID NO: 234  Cys Cys Ser Phe Cys Cys Asn Pro Ala Cys Ala Gly Cys Tyr

SEQ ID NO: 235  Cys Cys Ser Tyr Cys Cys Asn Pro Ala Cys Ala Gly Cys Tyr

SEQ ID NO: 236  Cys Cys Ser Dopa Cys Cys Asn Pro Ala Cys Ala Gly Cys Tyr

SEQ ID NO: 237  Cys Cys Ser NMe-Leu Cys Cys Asn Pro Ala Cys Ala Gly Cys Tyr

SEQ ID NO: 238  Cys Cys hSer Thr Cys Cys Asn Pro Ala Cys Ala Gly Cys Tyr

SEQ ID NO: 239  Cys Cys hSer hLeu Cys Cys Asn Pro Ala Cys Ala Gly Cys Tyr

SEQ ID NO: 240  Cys Cys hSer norLeu Cys Cys Asn Pro Ala Cys Ala Gly Cys Tyr

SEQ ID NO: 241  Cys Cys hSer ChxAla Cys Cys Asn Pro Ala Cys Ala Gly Cys Tyr

SEQ ID NO: 242  Cys Cys hSer ChxIle Cys Cys Asn Pro Ala Cys Ala Gly Cys Tyr

SEQ ID NO: 243  Cys Cys hSer Phe Cys Cys Asn Pro Ala Cys Ala Gly Cys Tyr

SEQ ID NO: 244  Cys Cys hSer Tyr Cys Cys Asn Pro Ala Cys Ala Gly Cys Tyr

SEQ ID NO: 245  Cys Cys hSer Dopa Cys Cys Asn Pro Ala Cys Ala Gly Cys Tyr

SEQ ID NO: 246  Cys Cys hSer NMe-Leu Cys Cys Asn Pro Ala Cys Ala Gly Cys Tyr

SEQ ID NO: 247  Thr Csa Thr Cys Cys Asn Pro Ala Cys Ala Gly Cys Tyr

SEQ ID NO: 248  Cys Cys Csa hLeu Cys Cys Asn Pro Ala Cys Ala Gly Cys Tyr

SEQ ID NO: 249  Cys Cys Csa norLeu Cys Cys Asn Pro Ala Cys Ala Gly Cys Tyr

SEQ ID NO: 250  Cys Cys Csa ChxAla Cys Cys Asn Pro Ala Cys Ala Gly Cys Tyr

SEQ ID NO: 251  Cys Cys Csa ChxIle Cys Cys Asn Pro Ala Cys Ala Gly Cys Tyr

SEQ ID NO: 252  Cys Cys Csa Phe Cys Cys Asn Pro Ala Cys Ala Gly Cys Tyr

SEQ ID NO: 253  Cys Cys Csa Tyr Cys Cys Asn Pro Ala Cys Ala Gly Cys Tyr

SEQ ID NO: 254  Cys Cys Csa Dopa Cys Cys Asn Pro Ala Cys Ala Gly Cys Tyr

SEQ ID NO: 255  Cys Cys Csa NMe-Leu Cys Cys Asn Pro Ala Cys Ala Gly Cys Tyr

SEQ ID NO: 256  Cys Cys Ser Leu Cys Cys Asn Dhp Ala Cys Ala Gly Cys Tyr

SEQ ID NO: 257  Cys Cys Ser Leu Cys Cys Asn Thz Ala Cys Ala Gly Cys Tyr

SEQ ID NO: 258  Cys Cys Ser Leu Cys Cys Asn HyPro Ala Cys Ala Gly Cys Tyr

SEQ ID NO: 259  Cys Cys Ser Leu Cys Cys Asn Pip Ala Cys Ala Gly Cys Tyr

SEQ ID NO: 260  Cys Cys Ser Leu Cys Cys Asn Ile Ala Cys Ala Gly Cys Tyr

SEQ ID NO: 261  Cys Cys Ser Leu Cys Cys Asn Ala Ala Cys Ala Gly Cys Tyr

SEQ ID NO: 262  Cys Cys hSer Leu Cys Cys Asn Dhp Ala Cys Ala Gly Cys Tyr

SEQ ID NO: 263  Cys Cys hSer Leu Cys Cys Asn Thz Ala Cys Ala Gly Cys Tyr

SEQ ID NO: 264  Cys Cys hSer Leu Cys Cys Asn HyPro Ala Cys Ala Gly Cys Tyr

SEQ ID NO: 265  Cys Cys hSer Leu Cys Cys Asn Pip Ala Cys Ala Gly Cys Tyr

SEQ ID NO: 266  Cys Cys hSer Leu Cys Cys Asn Ile Ala Cys Ala Gly Cys Tyr

TABLE 3B-continued

Double substitutions from Scheme 1

| SEQ ID NO: 267 | Cys Cys hSer Leu Cys Cys Asn Ala Ala Cys Ala Gly Cys Tyr |
| SEQ ID NO: 268 | Cys Cys Csa Leu Cys Cys Asn Dhp Ala Cys Ala Gly Cys Tyr |
| SEQ ID NO: 269 | Cys Cys Csa Leu Cys Cys Asn Thz Ala Cys Ala Gly Cys Tyr |
| SEQ ID NO: 270 | Cys Cys Csa Leu Cys Cys Asn HyPro Ala Cys Ala Gly Cys Tyr |
| SEQ ID NO: 271 | Cys Cys Csa Leu Cys Cys Asn Pip Ala Cys Ala Gly Cys Tyr |
| SEQ ID NO: 272 | Cys Cys Csa Leu Cys Cys Asn Ile Ala Cys Ala Gly Cys Tyr |
| SEQ ID NO: 273 | Cys Cys Csa Leu Cys Cys Asn Ala Ala Cys Ala Gly Cys Tyr |
| SEQ ID NO: 274 | Cys Cys Ser Leu Cys Cys Asn Pro Ala Cys Thr Gly Cys Tyr |
| SEQ ID NO: 275 | Cys Cys Ser Leu Cys Cys Asn Pro Ala Cys Ser Gly Cys Tyr |
| SEQ ID NO: 276 | Cys Cys Ser Leu Cys Cys Asn Pro Ala Cys 4F-Phe Gly Cys Tyr |
| SEQ ID NO: 277 | Cys Cys Ser Leu Cys Cys Asn Pro Ala Cys 4MeO-Phe Gly Cys Tyr |
| SEQ ID NO: 278 | Cys Cys Ser Leu Cys Cys Asn Pro Ala Cys 4NO2-Phe Gly Cys Tyr |
| SEQ ID NO: 279 | Cys Cys Ser Leu Cys Cys Asn Pro Ala Cys 5F-Phe Gly Cys Tyr |
| SEQ ID NO: 280 | Cys Cys Ser Leu Cys Cys Asn Pro Ala Cys 4MeF3-Phe Gly Cys Tyr |
| SEQ ID NO: 281 | Cys Cys hSer Leu Cys Cys Asn Pro Ala Cys Thr Gly Cys Tyr |
| SEQ ID NO: 282 | Cys Cys hSer Leu Cys Cys Asn Pro Ala Cys Ser Gly Cys Tyr |
| SEQ ID NO: 283 | Cys Cys hSer Leu Cys Cys Asn Pro Ala Cys 4F-Phe Gly Cys Tyr |
| SEQ ID NO: 284 | Cys Cys hSer Leu Cys Cys Asn Pro Ala Cys 4MeO-Phe Gly Cys Tyr |
| SEQ ID NO: 285 | Cys Cys hSer Leu Cys Cys Asn Pro Ala Cys 4NO2-Phe Gly Cys Tyr |
| SEQ ID NO: 286 | Cys Cys hSer Leu Cys Cys Asn Pro Ala Cys 5F-Phe Gly Cys Tyr |
| SEQ ID NO: 287 | Cys Cys hSer Leu Cys Cys Asn Pro Ala Cys 4MeF3-Phe Gly Cys Tyr |
| SEQ ID NO: 288 | Cys Cys Csa Leu Cys Cys Asn Pro Ala Cys Thr Gly Cys Tyr |
| SEQ ID NO: 289 | Cys Cys Csa Leu Cys Cys Asn Pro Ala Cys Ser Gly Cys Tyr |
| SEQ ID NO: 290 | Cys Cys Csa Leu Cys Cys Asn Pro Ala Cys 4F-Phe Gly Cys Tyr |
| SEQ ID NO: 291 | Cys Cys Csa Leu Cys Cys Asn Pro Ala Cys 4MeO-Phe Gly Cys Tyr |
| SEQ ID NO: 292 | Cys Cys Csa Leu Cys Cys Asn Pro Ala Cys 4NO2-Phe Gly Cys Tyr |
| SEQ ID NO: 293 | Cys Cys Csa Leu Cys Cys Asn Pro Ala Cys 5F-Phe Gly Cys Tyr |
| SEQ ID NO: 294 | Cys Cys Csa Leu Cys Cys Asn Pro Ala Cys 4MeF3-Phe Gly Cys Tyr |
| SEQ ID NO: 295 | Cys Cys Ser Leu Cys Cys Asn Pro Ala Cys Ala D-Ala Cys Tyr |
| SEQ ID NO: 296 | Cys Cys hSer Leu Cys Cys Asn Pro Ala Cys Ala D-Ala Cys Tyr |
| SEQ ID NO: 297 | Cys Cys Csa Leu Cys Cys Asn Pro Ala Cys Ala D-Ala Cys Tyr |
| SEQ ID NO: 298 | Cys Cys Ser Leu Cys Cys Asn Pro Ala Cys Ala Gly Cys Ile |
| SEQ ID NO: 299 | Cys Cys Ser Leu Cys Cys Asn Pro Ala Cys Ala Gly Cys Trp |
| SEQ ID NO: 300 | Cys Cys hSer Leu Cys Cys Asn Pro Ala Cys Ala Gly Cys Ile |
| SEQ ID NO: 301 | Cys Cys hSer Leu Cys Cys Asn Pro Ala Cys Ala Gly Cys Trp |
| SEQ ID NO: 302 | Cys Cys Csa Leu Cys Cys Asn Pro Ala Cys Ala Gly Cys Ile |
| SEQ ID NO: 303 | Cys Cys Csa Leu Cys Cys Asn Pro Ala Cys Ala Gly Cys Trp |
| SEQ ID NO: 304 | Cys Cys Glu Thr Cys Cys Asn Dhp Ala Cys Ala Gly Cys Tyr |
| SEQ ID NO: 305 | Cys Cys Glu Thr Cys Cys Asn Thz Ala Cys Ala Gly Cys Tyr |

TABLE 3B-continued

Double substitutions from Scheme 1

SEQ ID NO: 306  Cys Cys Glu Thr Cys Cys Asn HyPro Ala Cys Ala Gly Cys Tyr
SEQ ID NO: 307  Cys Cys Glu Thr Cys Cys Asn Pip Ala Cys Ala Gly Cys Tyr
SEQ ID NO: 308  Cys Cys Glu Thr Cys Cys Asn Ile Ala Cys Ala Gly Cys Tyr
SEQ ID NO: 309  Cys Cys Glu Thr Cys Cys Asn Ala Ala Cys Ala Gly Cys Tyr
SEQ ID NO: 310  Cys Cys Glu hLeu Cys Cys Asn Dhp Ala Cys Ala Gly Cys Tyr
SEQ ID NO: 311  Cys Cys Glu hLeu Cys Cys Asn Thz Ala Cys Ala Gly Cys Tyr
SEQ ID NO: 312  Cys Cys Glu hLeu Cys Cys Asn HyPro Ala Cys Ala Gly Cys Tyr
SEQ ID NO: 313  Cys Cys Glu hLeu Cys Cys Asn Pip Ala Cys Ala Gly Cys Tyr
SEQ ID NO: 314  Cys Cys Glu hLeu Cys Cys Asn Ile Ala Cys Ala Gly Cys Tyr
SEQ ID NO: 315  Cys Cys Glu hLeu Cys Cys Asn Ala Ala Cys Ala Gly Cys Tyr
SEQ ID NO: 316  Cys Cys Glu norLeu Cys Cys Asn Dhp Ala Cys Ala Gly Cys Tyr
SEQ ID NO: 317  Cys Cys Glu norLeu Cys Cys Asn Thz Ala Cys Ala Gly Cys Tyr
SEQ ID NO: 318  Cys Cys Glu norLeu Cys Cys Asn HyPro Ala Cys Ala Gly Cys Tyr
SEQ ID NO: 319  Cys Cys Glu norLeu Cys Cys Asn Pip Ala Cys Ala Gly Cys Tyr
SEQ ID NO: 320  Cys Cys Glu norLeu Cys Cys Asn Ile Ala Cys Ala Gly Cys Tyr
SEQ ID NO: 321  Cys Cys Glu norLeu Cys Cys Asn Ala Ala Cys Ala Gly Cys Tyr
SEQ ID NO: 322  Cys Cys Glu ChxAla Cys Cys Asn Dhp Ala Cys Ala Gly Cys Tyr
SEQ ID NO: 323  Cys Cys Glu ChxAla Cys Cys Asn Thz Ala Cys Ala Gly Cys Tyr
SEQ ID NO: 324  Cys Cys Glu ChxAla Cys Cys Asn HyPro Ala Cys Ala Gly Cys Tyr
SEQ ID NO: 325  Cys Cys Glu ChxAla Cys Cys Asn Pip Ala Cys Ala Gly Cys Tyr
SEQ ID NO: 326  Cys Cys Glu ChxAla Cys Cys Asn Ile Ala Cys Ala Gly Cys Tyr
SEQ ID NO: 327  Cys Cys Glu ChxAla Cys Cys Asn Ala Ala Cys Ala Gly Cys Tyr
SEQ ID NO: 328  Cys Cys Glu ChxIle Cys Cys Asn Dhp Ala Cys Ala Gly Cys Tyr
SEQ ID NO: 329  Cys Cys Glu ChxIle Cys Cys Asn Thz Ala Cys Ala Gly Cys Tyr
SEQ ID NO: 330  Cys Cys Glu ChxIle Cys Cys Asn HyPro Ala Cys Ala Gly Cys Tyr
SEQ ID NO: 331  Cys Cys Glu ChxIle Cys Cys Asn Pip Ala Cys Ala Gly Cys Tyr
SEQ ID NO: 332  Cys Cys Glu ChxIle Cys Cys Asn Ile Ala Cys Ala Gly Cys Tyr
SEQ ID NO: 333  Cys Cys Glu ChxIle Cys Cys Asn Ala Ala Cys Ala Gly Cys Tyr
SEQ ID NO: 334  Cys Cys Glu Phe Cys Cys Asn Dhp Ala Cys Ala Gly Cys Tyr
SEQ ID NO: 335  Cys Cys Glu Phe Cys Cys Asn Thz Ala Cys Ala Gly Cys Tyr
SEQ ID NO: 336  Cys Cys Glu Phe Cys Cys Asn HyPro Ala Cys Ala Gly Cys Tyr
SEQ ID NO: 337  Cys Cys Glu Phe Cys Cys Asn Pip Ala Cys Ala Gly Cys Tyr
SEQ ID NO: 338  Cys Cys Glu Phe Cys Cys Asn Ile Ala Cys Ala Gly Cys Tyr
SEQ ID NO: 339  Cys Cys Glu Phe Cys Cys Asn Ala Ala Cys Ala Gly Cys Tyr
SEQ ID NO: 340  Cys Cys Glu Tyr Cys Cys Asn Dhp Ala Cys Ala Gly Cys Tyr
SEQ ID NO: 341  Cys Cys Glu Tyr Cys Cys Asn Thz Ala Cys Ala Gly Cys Tyr
SEQ ID NO: 342  Cys Cys Glu Tyr Cys Cys Asn HyPro Ala Cys Ala Gly Cys Tyr
SEQ ID NO: 343  Cys Cys Glu Tyr Cys Cys Asn Pip Ala Cys Ala Gly Cys Tyr
SEQ ID NO: 344  Cys Cys Glu Tyr Cys Cys Asn Ile Ala Cys Ala Gly Cys Tyr

TABLE 3B-continued

Double substitutions from Scheme 1

SEQ ID NO: 345  Cys Cys Glu Tyr Cys Cys Asn Ala Ala Cys Ala Gly Cys Tyr

SEQ ID NO: 346  Cys Cys Glu Dopa Cys Cys Asn Dhp Ala Cys Ala Gly Cys Tyr

SEQ ID NO: 347  Cys Cys Glu Dopa Cys Cys Asn Thz Ala Cys Ala Gly Cys Tyr

SEQ ID NO: 348  Cys Cys Glu Dopa Cys Cys Asn HyPro Ala Cys Ala Gly Cys Tyr

SEQ ID NO: 349  Cys Cys Glu Dopa Cys Cys Asn Pip Ala Cys Ala Gly Cys Tyr

SEQ ID NO: 350  Cys Cys Glu Dopa Cys Cys Asn Ile Ala Cys Ala Gly Cys Tyr

SEQ ID NO: 351  Cys Cys Glu Dopa Cys Cys Asn Ala Ala Cys Ala Gly Cys Tyr

SEQ ID NO: 352  Cys Cys Glu NMe-Leu Cys Cys Asn Dhp Ala Cys Ala Gly Cys Tyr

SEQ ID NO: 353  Cys Cys Glu NMe-Leu Cys Cys Asn Thz Ala Cys Ala Gly Cys Tyr

SEQ ID NO: 354  Cys Cys Glu NMe-Leu Cys Cys Asn HyPro Ala Cys Ala Gly Cys Tyr

SEQ ID NO: 355  Cys Cys Glu NMe-Leu Cys Cys Asn Pip Ala Cys Ala Gly Cys Tyr

SEQ ID NO: 356  Cys Cys Glu NMe-Leu Cys Cys Asn Ile Ala Cys Ala Gly Cys Tyr

SEQ ID NO: 357  Cys Cys Glu NMe-Leu Cys Cys Asn Ala Ala Cys Ala Gly Cys Tyr

SEQ ID NO: 358  Cys Cys Glu Thr Cys Cys Asn Pro Ala Cys Thr Gly Cys Tyr

SEQ ID NO: 359  Cys Cys Glu Thr Cys Cys Asn Pro Ala Cys Ser Gly Cys Tyr

SEQ ID NO: 360  Cys Cys Glu Thr Cys Cys Asn Pro Ala Cys 4F-Phe Gly Cys Tyr

SEQ ID NO: 361  Cys Cys Glu Thr Cys Cys Asn Pro Ala Cys 4MeO-Phe Gly Cys Tyr

SEQ ID NO: 362  Cys Cys Glu Thr Cys Cys Asn Pro Ala Cys 4NO2-Phe Gly Cys Tyr

SEQ ID NO: 363  Cys Cys Glu Thr Cys Cys Asn Pro Ala Cys 5F-Phe Gly Cys Tyr

SEQ ID NO: 364  Cys Cys Glu hLeu Cys Cys Asn Pro Ala Cys 4MeF3-Phe Gly Cys Tyr

SEQ ID NO: 365  Cys Cys Glu hLeu Cys Cys Asn Pro Ala Cys Ser Gly Cys Tyr

SEQ ID NO: 366  Cys Cys Glu hLeu Cys Cys Asn Pro Ala Cys 4F-Phe Gly Cys Tyr

SEQ ID NO: 367  Cys Cys Glu hLeu Cys Cys Asn Pro Ala Cys 4MeO-Phe Gly Cys Tyr

SEQ ID NO: 368  Cys Cys Glu hLeu Cys Cys Asn Pro Ala Cys 4NO2-Phe Gly Cys Tyr

SEQ ID NO: 369  Cys Cys Glu hLeu Cys Cys Asn Pro Ala Cys 5F-Phe Gly Cys Tyr

SEQ ID NO: 370  Cys Cys Glu hLeu Cys Cys Asn Pro Ala Cys 4MeF3-Phe Gly Cys Tyr

SEQ ID NO: 371  Cys Cys Glu norLeu Cys Cys Asn Pro Ala Cys Thr Gly Cys Tyr

SEQ ID NO: 372  Cys Cys Glu norLeu Cys Cys Asn Pro Ala Cys Ser Gly Cys Tyr

SEQ ID NO: 373  Cys Cys Glu norLeu Cys Cys Asn Pro Ala Cys 4F-Phe Gly Cys Tyr

SEQ ID NO: 374  Cys Cys Glu norLeu Cys Cys Asn Pro Ala Cys 4MeO-Phe Gly Cys Tyr

SEQ ID NO: 375  Cys Cys Glu norLeu Cys Cys Asn Pro Ala Cys 4NO2-Phe Gly Cys Tyr

SEQ ID NO: 376  Cys Cys Glu norLeu Cys Cys Asn Pro Ala Cys 5F-Phe Gly Cys Tyr

SEQ ID NO: 377  Cys Cys Glu norLeu Cys Cys Asn Pro Ala Cys 4MeF3-Phe Gly Cys Tyr SEQ ID NO: 378  Cys Cys Glu norLeu Cys Cys Asn Pro Ala Cys Thr Gly Cys Tyr SEQ ID NO: 379  Cys Cys Glu ChxAla Cys Cys Asn Pro Ala Cys Ser Gly Cys Tyr SEQ ID NO: 380  Cys Cys Glu ChxAla Cys Cys Asn Pro Ala Cys 4F-Phe Gly Cys Tyr SEQ ID NO: 381  Cys Cys Glu ChxAla Cys Cys Asn Pro Ala Cys 4MeO-Phe Gly Cys Tyr SEQ ID NO: 382  Cys Cys Glu ChxAla Cys Cys Asn Pro Ala Cys 4NO2-Phe Gly Cys Tyr SEQ ID NO: 383  Cys Cys Glu ChxAla Cys Cys Asn Pro Ala Cys 5F-Phe Gly Cys Tyr

TABLE 3B-continued

Double substitutions from Scheme 1

| | |
|---|---|
| SEQ ID NO: 384 | Cys Cys Glu ChxAla Cys Cys Asn Pro Ala Cys 4MeF3-Phe Gly Cys Tyr |
| SEQ ID NO: 385 | Cys Cys Glu ChxIle Cys Cys Asn Pro Ala Cys Thr Gly Cys Tyr |
| SEQ ID NO: 386 | Cys Cys Glu ChxIle Cys Cys Asn Pro Ala Cys Ser Gly Cys Tyr |
| SEQ ID NO: 387 | Cys Cys Glu ChxIle Cys Cys Asn Pro Ala Cys 4F-Phe Gly Cys Tyr |
| SEQ ID NO: 388 | Cys Cys Glu ChxIle Cys Cys Asn Pro Ala Cys 4MeO-Phe Gly Cys Tyr |
| SEQ ID NO: 389 | Cys Cys Glu ChxIle Cys Cys Asn Pro Ala Cys 4NO2-Phe Gly Cys Tyr |
| SEQ ID NO: 390 | Cys Cys Glu ChxIle Cys Cys Asn Pro Ala Cys 5F-Phe Gly Cys Tyr |
| SEQ ID NO: 391 | Cys Cys Glu ChxIle Cys Cys Asn Pro Ala Cys 4MeF3-Phe Gly Cys Tyr |
| SEQ ID NO: 392 | Cys Cys Glu Phe Cys Cys Asn Pro Ala Cys Thr Gly Cys Tyr |
| SEQ ID NO: 393 | Cys Cys Glu Phe Cys Cys Asn Pro Ala Cys Ser Gly Cys Tyr |
| SEQ ID NO: 394 | Cys Cys Glu Phe Cys Cys Asn Pro Ala Cys 4F-Phe Gly Cys Tyr |
| SEQ ID NO: 395 | Cys Cys Glu Phe Cys Cys Asn Pro Ala Cys 4MeO-Phe Gly Cys Tyr |
| SEQ ID NO: 396 | Cys Cys Glu Phe Cys Cys Asn Pro Ala Cys 4NO2-Phe Gly Cys Tyr |
| SEQ ID NO: 397 | Cys Cys Glu Phe Cys Cys Asn Pro Ala Cys 5F-Phe Gly Cys Tyr |
| SEQ ID NO: 398 | Cys Cys Glu Phe Cys Cys Asn Pro Ala Cys 4MeF3-Phe Gly Cys Tyr |
| SEQ ID NO: 399 | Cys Cys Glu Tyr Cys Cys Asn Pro Ala Cys Thr Gly Cys Tyr |
| SEQ ID NO: 400 | Cys Cys Glu Tyr Cys Cys Asn Pro Ala Cys Ser Gly Cys Tyr |
| SEQ ID NO: 401 | Cys Cys Glu Tyr Cys Cys Asn Pro Ala Cys 4F-Phe Gly Cys Tyr |
| SEQ ID NO: 402 | Cys Cys Glu Tyr Cys Cys Asn Pro Ala Cys 4MeO-Phe Gly Cys Tyr |
| SEQ ID NO: 403 | Cys Cys Glu Tyr Cys Cys Asn Pro Ala Cys 4NO2-Phe Gly Cys Tyr |
| SEQ ID NO: 404 | Cys Cys Glu Tyr Cys Cys Asn Pro Ala Cys 5F-Phe Gly Cys Tyr |
| SEQ ID NO: 405 | Cys Cys Glu Tyr Cys Cys Asn Pro Ala Cys 4MeF3-Phe Gly Cys Tyr |
| SEQ ID NO: 406 | Cys Cys Glu Dopa Cys Cys Asn Pro Ala Cys Thr Gly Cys Tyr |
| SEQ ID NO: 407 | Cys Cys Glu Dopa Cys Cys Asn Pro Ala Cys Ser Gly Cys Tyr |
| SEQ ID NO: 408 | Cys Cys Glu Dopa Cys Cys Asn Pro Ala Cys 4F-Phe Gly Cys Tyr |
| SEQ ID NO: 409 | Cys Cys Glu Dopa Cys Cys Asn Pro Ala Cys 4MeO-Phe Gly Cys Tyr |
| SEQ ID NO: 410 | Cys Cys Glu Dopa Cys Cys Asn Pro Ala Cys 4NO2-Phe Gly Cys Tyr |
| SEQ ID NO: 411 | Cys Cys Glu Dopa Cys Cys Asn Pro Ala Cys 5F-Phe Gly Cys Tyr |
| SEQ ID NO: 412 | Cys Cys Glu Dopa Cys Cys Asn Pro Ala Cys 4MeF3-Phe Gly Cys Tyr |
| SEQ ID NO: 413 | Cys Cys Glu NMe-Leu Cys Cys Asn Pro Ala Cys Thr Gly Cys Tyr |
| SEQ ID NO: 414 | Cys Cys Glu NMe-Leu Cys Cys Asn Pro Ala Cys Ser Gly Cys Tyr |
| SEQ ID NO: 415 | Cys Cys Glu NMe-Leu Cys Cys Asn Pro Ala Cys 4F-Phe Gly Cys Tyr |
| SEQ ID NO: 416 | Cys Cys Glu NMe-Leu Cys Cys Asn Pro Ala Cys 4MeO-Phe Gly Cys Tyr |
| SEQ ID NO: 417 | Cys Cys Glu NMe-Leu Cys Cys Asn Pro Ala Cys 4NO2-Phe Gly Cys Tyr |
| SEQ ID NO: 418 | Cys Cys Glu NMe-Leu Cys Cys Asn Pro Ala Cys 5F-Phe Gly Cys Tyr |
| SEQ ID NO: 419 | Cys Cys Glu NMe-Leu Cys Cys Asn Pro Ala Cys 4MeF3-Phe Gly Cys Tyr |
| SEQ ID NO: 420 | Cys Cys Glu Thr Cys Cys Asn Pro Ala Cys Ala D-Ala Cys Tyr |
| SEQ ID NO: 421 | Cys Cys Glu hLeu Cys Cys Asn Pro Ala Cys Ala D-Ala Cys Tyr |
| SEQ ID NO: 422 | Cys Cys Glu norLeu Cys Cys Asn Pro Ala Cys Ala D-Ala Cys Tyr |

TABLE 3B-continued

Double substitutions from Scheme 1

SEQ ID NO: 423  Cys Cys Glu ChxAla Cys Cys Asn Pro Ala Cys Ala D-Ala Cys Tyr
SEQ ID NO: 424  Cys Cys Glu ChxIle Cys Cys Asn Pro Ala Cys Ala D-Ala Cys Tyr
SEQ ID NO: 425  Cys Cys Glu Phe Cys Cys Asn Pro Ala Cys Ala D-Ala Cys Tyr
SEQ ID NO: 426  Cys Cys Glu Tyr Cys Cys Asn Pro Ala Cys Ala D-Ala Cys Tyr
SEQ ID NO: 427  Cys Cys Glu Dopa Cys Cys Asn Pro Ala Cys Ala D-Ala Cys Tyr
SEQ ID NO: 428  Cys Cys Glu NMe-Leu Cys Cys Asn Pro Ala Cys Ala D-Ala Cys Tyr
SEQ ID NO: 429  Cys Cys Glu Thr Cys Cys Asn Pro Ala Cys Ala Gly Cys Ile
SEQ ID NO: 430  Cys Cys Glu Thr Cys Cys Asn Pro Ala Cys Ala Gly Cys Trp
SEQ ID NO: 431  Cys Cys Glu hLeu Cys Cys Asn Pro Ala Cys Ala Gly Cys Ile
SEQ ID NO: 432  Cys Cys Glu hLeu Cys Cys Asn Pro Ala Cys Ala Gly Cys Trp
SEQ ID NO: 433  Cys Cys Glu norLeu Cys Cys Asn Pro Ala Cys Ala Gly Cys Ile
SEQ ID NO: 434  Cys Cys Glu norLeu Cys Cys Asn Pro Ala Cys Ala Gly Cys Trp
SEQ ID NO: 435  Cys Cys Glu ChxAla Cys Cys Asn Pro Ala Cys Ala Gly Cys Ile
SEQ ID NO: 436  Cys Cys Glu ChxAla Cys Cys Asn Pro Ala Cys Ala Gly Cys Trp
SEQ ID NO: 437  Cys Cys Glu ChxIle Cys Cys Asn Pro Ala Cys Ala Gly Cys Ile
SEQ ID NO: 438  Cys Cys Glu ChxIle Cys Cys Asn Pro Ala Cys Ala Gly Cys Trp
SEQ ID NO: 439  Cys Cys Glu Phe Cys Cys Asn Pro Ala Cys Ala Gly Cys Ile
SEQ ID NO: 440  Cys Cys Glu Phe Cys Cys Asn Pro Ala Cys Ala Gly Cys Trp
SEQ ID NO: 441  Cys Cys Glu Tyr Cys Cys Asn Pro Ala Cys Ala Gly Cys Ile
SEQ ID NO: 442  Cys Cys Glu Tyr Cys Cys Asn Pro Ala Cys Ala Gly Cys Trp
SEQ ID NO: 443  Cys Cys Glu Dopa Cys Cys Asn Pro Ala Cys Ala Gly Cys Ile
SEQ ID NO: 444  Cys Cys Glu Dopa Cys Cys Asn Pro Ala Cys Ala Gly Cys Trp
SEQ ID NO: 445  Cys Cys Glu NMe-Leu Cys Cys Asn Pro Ala Cys Ala Gly Cys Ile
SEQ ID NO: 446  Cys Cys Glu NMe-Leu Cys Cys Asn Pro Ala Cys Ala Gly Cys Trp
SEQ ID NO: 447  Cys Cys Glu Leu Cys Cys Asn Dhp Ala Cys Thr Gly Cys Tyr
SEQ ID NO: 448  Cys Cys Glu Leu Cys Cys Asn Dhp Ala Cys Ser Gly Cys Tyr
SEQ ID NO: 449  Cys Cys Glu Leu Cys Cys Asn Dhp Ala Cys 4F-Phe Gly Cys Tyr
SEQ ID NO: 450  Cys Cys Glu Leu Cys Cys Asn Dhp Ala Cys 4MeO-Phe Gly Cys Tyr
SEQ ID NO: 451  Cys Cys Glu Leu Cys Cys Asn Dhp Ala Cys 4NO2-Phe Gly Cys Tyr
SEQ ID NO: 452  Cys Cys Glu Leu Cys Cys Asn Dhp Ala Cys 5F-Phe Gly Cys Tyr
SEQ ID NO: 453  Cys Cys Glu Leu Cys Cys Asn Dhp Ala Cys 4MeF3-Phe Gly Cys Tyr
SEQ ID NO: 454  Cys Cys Glu Leu Cys Cys Asn Thz Ala Cys Thr Gly Cys Tyr
SEQ ID NO: 455  Cys Cys Glu Leu Cys Cys Asn Thz Ala Cys Ser Gly Cys Tyr
SEQ ID NO: 456  Cys Cys Glu Leu Cys Cys Asn Thz Ala Cys 4F-Phe Gly Cys Tyr
SEQ ID NO: 457  Cys Cys Glu Leu Cys Cys Asn Thz Ala Cys 4MeO-Phe Gly Cys Tyr
SEQ ID NO: 458  Cys Cys Glu Leu Cys Cys Asn Thz Ala Cys 4NO2-Phe Gly Cys Tyr
SEQ ID NO: 459  Cys Cys Glu Leu Cys Cys Asn Thz Ala Cys 5F-Phe Gly Cys Tyr
SEQ ID NO: 460  Cys Cys Glu Leu Cys Cys Asn Thz Ala Cys 4MeF3-Phe Gly Cys Tyr
SEQ ID NO: 461  Cys Cys Glu Leu Cys Cys Asn HyPro Ala Cys Thr Gly Cys Tyr TABLE 3B-continued Double substitutions from Scheme 1

SEQ ID NO: 462    Cys Cys Glu Leu Cys Cys Asn HyPro Ala Cys Ser Gly Cys Tyr
SEQ ID NO: 463    Cys Cys Glu Leu Cys Cys Asn HyPro Ala Cys 4F-Phe Gly Cys Tyr
SEQ ID NO: 464    Cys Cys Glu Leu Cys Cys Asn HyPro Ala Cys 4MeO-Phe Gly Cys Tyr
SEQ ID NO: 465    Cys Cys Glu Leu Cys Cys Asn HyPro Ala Cys 4NO2-Phe Gly Cys Tyr
SEQ ID NO: 466    Cys Cys Glu Leu Cys Cys Asn HyPro Ala Cys 5F-Phe Gly Cys Tyr
SEQ ID NO: 467    Cys Cys Glu Leu Cys Cys Asn HyPro Ala Cys 4MeF3-Phe Gly Cys Tyr
SEQ ID NO: 468    Cys Cys Glu Leu Cys Cys Asn Pip Ala Cys Thr Gly Cys Tyr
SEQ ID NO: 469    Cys Cys Glu Leu Cys Cys Asn Pip Ala Cys Ser Gly Cys Tyr
SEQ ID NO: 470    Cys Cys Glu Leu Cys Cys Asn Pip Ala Cys 4F-Phe Gly Cys Tyr
SEQ ID NO: 471    Cys Cys Glu Leu Cys Cys Asn Pip Ala Cys 4MeO-Phe Gly Cys Tyr
SEQ ID NO: 472    Cys Cys Glu Leu Cys Cys Asn Pip Ala Cys 4NO2-Phe Gly Cys Tyr
SEQ ID NO: 473    Cys Cys Glu Leu Cys Cys Asn Pip Ala Cys 5F-Phe Gly Cys Tyr
SEQ ID NO: 474    Cys Cys Glu Leu Cys Cys Asn Pip Ala Cys 4MeF3-Phe Gly Cys Tyr
SEQ ID NO: 475    Cys Cys Glu Leu Cys Cys Asn Ile Ala Cys Thr Gly Cys Tyr
SEQ ID NO: 476    Cys Cys Glu Leu Cys Cys Asn Ile Ala Cys Ser Gly Cys Tyr
SEQ ID NO: 477    Cys Cys Glu Leu Cys Cys Asn Ile Ala Cys 4F-Phe Gly Cys Tyr
SEQ ID NO: 478    Cys Cys Glu Leu Cys Cys Asn Ile Ala Cys 4MeO-Phe Gly Cys Tyr
SEQ ID NO: 479    Cys Cys Glu Leu Cys Cys Asn Ile Ala Cys 4NO2-Phe Gly Cys Tyr
SEQ ID NO: 480    Cys Cys Glu Leu Cys Cys Asn Ile Ala Cys 5F-Phe Gly Cys Tyr
SEQ ID NO: 481    Cys Cys Glu Leu Cys Cys Asn Ile Ala Cys 4MeF3-Phe Gly Cys Tyr
SEQ ID NO: 482    Cys Cys Glu Leu Cys Cys Asn Ala Ala Cys Thr Gly Cys Tyr
SEQ ID NO: 483    Cys Cys Glu Leu Cys Cys Asn Ala Ala Cys Ser Gly Cys Tyr
SEQ ID NO: 484    Cys Cys Glu Leu Cys Cys Asn Ala Ala Cys 4F-Phe Gly Cys Tyr
SEQ ID NO: 485    Cys Cys Glu Leu Cys Cys Asn Ala Ala Cys 4MeO-Phe Gly Cys Tyr
SEQ ID NO: 486    Cys Cys Glu Leu Cys Cys Asn Ala Ala Cys 4NO2-Phe Gly Cys Tyr
SEQ ID NO: 487    Cys Cys Glu Leu Cys Cys Asn Ala Ala Cys 5F-Phe Gly Cys Tyr
SEQ ID NO: 488    Cys Cys Glu Leu Cys Cys Asn Ala Ala Cys 4MeF3-Phe Gly Cys Tyr
SEQ ID NO: 489    Cys Cys Glu Leu Cys Cys Asn Dhp Ala Cys Ala D-Ala Cys Tyr
SEQ ID NO: 490    Cys Cys Glu Leu Cys Cys Asn Thz Ala Cys Ala D-Ala Cys Tyr
SEQ ID NO: 491    Cys Cys Glu Leu Cys Cys Asn HyPro Ala Cys Ala D-Ala Cys Tyr
SEQ ID NO: 492    Cys Cys Glu Leu Cys Cys Asn Pip Ala Cys Ala D-Ala Cys Tyr
SEQ ID NO: 493    Cys Cys Glu Leu Cys Cys Asn Ile Ala Cys Ala D-Ala Cys Tyr
SEQ ID NO: 494    Cys Cys Glu Leu Cys Cys Asn Ala Ala Cys Ala D-Ala Cys Tyr
SEQ ID NO: 495    Cys Cys Glu Leu Cys Cys Asn Dhp Ala Cys Ala Gly Cys Ile
SEQ ID NO: 496    Cys Cys Glu Leu Cys Cys Asn Thz Ala Cys Ala Gly Cys Ile
SEQ ID NO: 497    Cys Cys Glu Leu Cys Cys Asn HyPro Ala Cys Ala Gly Cys Ile
SEQ ID NO: 498    Cys Cys Glu Leu Cys Cys Asn Pip Ala Cys Ala Gly Cys Ile
SEQ ID NO: 499    Cys Cys Glu Leu Cys Cys Asn Ile Ala Cys Ala Gly Cys Ile
SEQ ID NO: 500    Cys Cys Glu Leu Cys Cys Asn Ala Ala Cys Ala Gly Cys Ile

TABLE 3B-continued

Double substitutions from Scheme 1

| | |
|---|---|
| SEQ ID NO: 501 | Cys Cys Glu Leu Cys Cys Asn Dhp Ala Cys Ala Gly Cys Trp |
| SEQ ID NO: 502 | Cys Cys Glu Leu Cys Cys Asn Thz Ala Cys Ala Gly Cys Trp |
| SEQ ID NO: 503 | Cys Cys Glu Leu Cys Cys Asn HyPro Ala Cys Ala Gly Cys Trp |
| SEQ ID NO: 504 | Cys Cys Glu Leu Cys Cys Asn Pip Ala Cys Ala Gly Cys Trp |
| SEQ ID NO: 505 | Cys Cys Glu Leu Cys Cys Asn Ile Ala Cys Ala Gly Cys Trp |
| SEQ ID NO: 506 | Cys Cys Glu Leu Cys Cys Asn Ala Ala Cys Ala Gly Cys Trp |
| SEQ ID NO: 507 | Cys Cys Glu Leu Cys Cys Asn Pro Ala Cys Thr D-Ala Cys Tyr |
| SEQ ID NO: 508 | Cys Cys Glu Leu Cys Cys Asn Pro Ala Cys Ser D-Ala Cys Tyr |
| SEQ ID NO: 509 | Cys Cys Glu Leu Cys Cys Asn Pro Ala Cys 4F-Phe D-Ala Cys Tyr |
| SEQ ID NO: 510 | Cys Cys Glu Leu Cys Cys Asn Pro Ala Cys 4MeO-Phe D-Ala Cys Tyr |
| SEQ ID NO: 511 | Cys Cys Glu Leu Cys Cys Asn Pro Ala Cys 4NO2-Phe D-Ala Cys Tyr |
| SEQ ID NO: 512 | Cys Cys Glu Leu Cys Cys Asn Pro Ala Cys 5F-Phe D-Ala Cys Tyr |
| SEQ ID NO: 513 | Cys Cys Glu Leu Cys Cys Asn Pro Ala Cys 4MeF3-Phe D-Ala Cys Tyr |
| SEQ ID NO: 514 | Cys Cys Glu Leu Cys Cys Asn Pro Ala Cys Thr Gly Cys Ile |
| SEQ ID NO: 515 | Cys Cys Glu Leu Cys Cys Asn Pro Ala Cys Ser Gly Cys Ile |
| SEQ ID NO: 516 | Cys Cys Glu Leu Cys Cys Asn Pro Ala Cys 4F-Phe Gly Cys Ile |
| SEQ ID NO: 517 | Cys Cys Glu Leu Cys Cys Asn Pro Ala Cys 4MeO-Phe Gly Cys Ile |
| SEQ ID NO: 518 | Cys Cys Glu Leu Cys Cys Asn Pro Ala Cys 4NO2-Phe Gly Cys Ile |
| SEQ ID NO: 519 | Cys Cys Glu Leu Cys Cys Asn Pro Ala Cys 5F-Phe Gly Cys Ile |
| SEQ ID NO: 520 | Cys Cys Glu Leu Cys Cys Asn Pro Ala Cys 4MeF3-Phe Gly Cys Ile |
| SEQ ID NO: 521 | Cys Cys Glu Leu Cys Cys Asn Pro Ala Cys Thr Gly Cys Trp |
| SEQ ID NO: 522 | Cys Cys Glu Leu Cys Cys Asn Pro Ala Cys Ser Gly Cys Trp |
| SEQ ID NO: 523 | Cys Cys Glu Leu Cys Cys Asn Pro Ala Cys 4F-Phe Gly Cys Trp |
| SEQ ID NO: 524 | Cys Cys Glu Leu Cys Cys Asn Pro Ala Cys 4MeO-Phe Gly Cys Trp |
| SEQ ID NO: 525 | Cys Cys Glu Leu Cys Cys Asn Pro Ala Cys 4NO2-Phe Gly Cys Trp |
| SEQ ID NO: 526 | Cys Cys Glu Leu Cys Cys Asn Pro Ala Cys 5F-Phe Gly Cys Trp |
| SEQ ID NO: 527 | Cys Cys Glu Leu Cys Cys Asn Pro Ala Cys 4MeF3-Phe Gly Cys Trp |
| SEQ ID NO: 528 | Cys Cys Glu Leu Cys Cys Asn Pro Ala Cys Ala D-Ala Cys Ile |
| SEQ ID NO: 529 | Cys Cys Glu Leu Cys Cys Asn Pro Ala Cys Ala D-Ala Cys Trp |

TABLE 3C

Triple substitutions from Scheme 1

| | |
|---|---|
| SEQ ID NO: 600 | Cys Cys Glu norLeu Pen Cys Asn Pro Ala Cys Ala Gly Pen Tyr |
| SEQ ID NO: 601 | Mpr Cys Ser Thr Cys Cys Asn Pro Ala Cys Ala Gly Cys Tyr |
| SEQ ID NO: 602 | Mpr Cys Ser hLeu Cys Cys Asn Pro Ala Cys Ala Gly Cys Tyr |
| SEQ ID NO: 603 | Mpr Cys Ser norLeu Cys Cys Asn Pro Ala Cys Ala Gly Cys Tyr |
| SEQ ID NO: 604 | Mpr Cys Ser ChxAla Cys Cys Asn Pro Ala Cys Ala Gly Cys Tyr |
| SEQ ID NO: 605 | Mpr Cys Ser ChxIle Cys Cys Asn Pro Ala Cys Ala Gly Cys Tyr |
| SEQ ID NO: 606 | Mpr Cys Ser Phe Cys Cys Asn Pro Ala Cys Ala Gly Cys Tyr |

TABLE 3C-continued

Triple substitutions from Scheme 1

| | |
|---|---|
| SEQ ID NO: 607 | Mpr Cys Ser Tyr Cys Cys Asn Pro Ala Cys Ala Gly Cys Tyr |
| SEQ ID NO: 608 | Mpr Cys Ser Dopa Cys Cys Asn Pro Ala Cys Ala Gly Cys Tyr |
| SEQ ID NO: 609 | Mpr Cys Ser NMe-Leu Cys Cys Asn Pro Ala Cys Ala Gly Cys Tyr |
| SEQ ID NO: 610 | Mpr Cys Ser Leu Cys Cys Asn Dhp Ala Cys Ala Gly Cys Tyr |
| SEQ ID NO: 611 | Mpr Cys Ser Leu Cys Cys Asn Thz Ala Cys Ala Gly Cys Tyr |
| SEQ ID NO: 612 | Mpr Cys Ser Leu Cys Cys Asn HyPro Ala Cys Ala Gly Cys Tyr |
| SEQ ID NO: 613 | Mpr Cys Ser Leu Cys Cys Asn Pip Ala Cys Ala Gly Cys Tyr |
| SEQ ID NO: 614 | Mpr Cys Ser Leu Cys Cys Asn Ile Ala Cys Ala Gly Cys Tyr |
| SEQ ID NO: 615 | Mpr Cys Ser Leu Cys Cys Asn Ala Ala Cys Ala Gly Cys Tyr |
| SEQ ID NO: 616 | Mpr Cys Ser Leu Cys Cys Asn Pro Ala Cys Thr Gly Cys Tyr |
| SEQ ID NO: 617 | Mpr Cys Ser Leu Cys Cys Asn Pro Ala Cys Ser Gly Cys Tyr |
| SEQ ID NO: 618 | Mpr Cys Ser Leu Cys Cys Asn Pro Ala Cys 4F-Phe Gly Cys Tyr |
| SEQ ID NO: 619 | Mpr Cys Ser Leu Cys Cys Asn Pro Ala Cys 4MeO-Phe Gly Cys Tyr |
| SEQ ID NO: 620 | Mpr Cys Ser Leu Cys Cys Asn Pro Ala Cys 4NO2-Phe Gly Cys Tyr |
| SEQ ID NO: 621 | Mpr Cys Ser Leu Cys Cys Asn Pro Ala Cys 5F-Phe Gly Cys Tyr |
| SEQ ID NO: 622 | Mpr Cys Ser Leu Cys Cys Asn Pro Ala Cys 4MeF3-Phe Gly Cys Tyr |
| SEQ ID NO: 623 | Mpr Cys Ser Leu Cys Cys Asn Pro Ala Cys Ala D-Ala Cys Tyr |
| SEQ ID NO: 624 | Mpr Cys Ser Leu Cys Cys Asn Pro Ala Cys Ala Gly Cys Ile |
| SEQ ID NO: 625 | Mpr Cys Ser Leu Cys Cys Asn Pro Ala Cys Ala Gly Cys Trp |
| SEQ ID NO: 626 | Mpr Cys hSer Thr Cys Cys Asn Pro Ala Cys Ala Gly Cys Tyr |
| SEQ ID NO: 627 | Mpr Cys hSer hLeu Cys Cys Asn Pro Ala Cys Ala Gly Cys Tyr |
| SEQ ID NO: 628 | Mpr Cys hSer norLeu Cys Cys Asn Pro Ala Cys Ala Gly Cys Tyr |
| SEQ ID NO: 629 | Mpr Cys hSer ChxAla Cys Cys Asn Pro Ala Cys Ala Gly Cys Tyr |
| SEQ ID NO: 630 | Mpr Cys hSer ChxIle Cys Cys Asn Pro Ala Cys Ala Gly Cys Tyr |
| SEQ ID NO: 631 | Mpr Cys hSer Phe Cys Cys Asn Pro Ala Cys Ala Gly Cys Tyr |
| SEQ ID NO: 632 | Mpr Cys hSer Tyr Cys Cys Asn Pro Ala Cys Ala Gly Cys Tyr |
| SEQ ID NO: 633 | Mpr Cys hSer Dopa Cys Cys Asn Pro Ala Cys Ala Gly Cys Tyr |
| SEQ ID NO: 634 | Mpr Cys hSer NMe-Leu Cys Cys Asn Pro Ala Cys Ala Gly Cys Tyr |
| SEQ ID NO: 635 | Mpr Cys hSer Leu Cys Cys Asn Dhp Ala Cys Ala Gly Cys Tyr |
| SEQ ID NO: 636 | Mpr Cys hSer Leu Cys Cys Asn Thz Ala Cys Ala Gly Cys Tyr |
| SEQ ID NO: 637 | Mpr Cys hSer Leu Cys Cys Asn HyPro Ala Cys Ala Gly Cys Tyr |
| SEQ ID NO: 638 | Mpr Cys hSer Leu Cys Cys Asn Pip Ala Cys Ala Gly Cys Tyr |
| SEQ ID NO: 639 | Mpr Cys hSer Leu Cys Cys Asn Ile Ala Cys Ala Gly Cys Tyr |
| SEQ ID NO: 640 | Mpr Cys hSer Leu Cys Cys Asn Ala Ala Cys Ala Gly Cys Tyr |
| SEQ ID NO: 641 | Mpr Cys hSer Leu Cys Cys Asn Pro Ala Cys Thr Gly Cys Tyr |
| SEQ ID NO: 642 | Mpr Cys hSer Leu Cys Cys Asn Pro Ala Cys Ser Gly Cys Tyr |
| SEQ ID NO: 643 | Mpr Cys hSer Leu Cys Cys Asn Pro Ala Cys 4F-Phe Gly Cys Tyr |
| SEQ ID NO: 644 | Mpr Cys hSer Leu Cys Cys Asn Pro Ala Cys 4MeO-Phe Gly Cys Tyr |
| SEQ ID NO: 645 | Mpr Cys hSer Leu Cys Cys Asn Pro Ala Cys 4NO2-Phe Gly Cys Tyr |

TABLE 3C-continued

Triple substitutions from Scheme 1

| SEQ ID NO: 646 | Mpr Cys hSer Leu Cys Cys Asn Pro Ala Cys 5F-Phe Gly Cys Tyr |
| SEQ ID NO: 647 | Mpr Cys hSer Leu Cys Cys Asn Pro Ala Cys 4MeF3-Phe Gly Cys Tyr |
| SEQ ID NO: 648 | Mpr Cys hSer Leu Cys Cys Asn Pro Ala Cys Ala D-Ala Cys Tyr |
| SEQ ID NO: 649 | Mpr Cys hSer Leu Cys Cys Asn Pro Ala Cys Ala Gly Cys Ile |
| SEQ ID NO: 650 | Mpr Cys hSer Leu Cys Cys Asn Pro Ala Cys Ala Gly Cys Trp |
| SEQ ID NO: 651 | Mpr Cys Csa Thr Cys Cys Asn Pro Ala Cys Ala Gly Cys Tyr |
| SEQ ID NO: 652 | Mpr Cys Csa hLeu Cys Cys Asn Pro Ala Cys Ala Gly Cys Tyr |
| SEQ ID NO: 653 | Mpr Cys Csa norLeu Cys Cys Asn Pro Ala Cys Ala Gly Cys Tyr |
| SEQ ID NO: 654 | Mpr Cys Csa ChxAla Cys Cys Asn Pro Ala Cys Ala Gly Cys Tyr |
| SEQ ID NO: 655 | Mpr Cys Csa ChxIle Cys Cys Asn Pro Ala Cys Ala Gly Cys Tyr |
| SEQ ID NO: 656 | Mpr Cys Csa Phe Cys Cys Asn Pro Ala Cys Ala Gly Cys Tyr |
| SEQ ID NO: 657 | Mpr Cys Csa Tyr Cys Cys Asn Pro Ala Cys Ala Gly Cys Tyr |
| SEQ ID NO: 658 | Mpr Cys Csa Dopa Cys Cys Asn Pro Ala Cys Ala Gly Cys Tyr |
| SEQ ID NO: 659 | Mpr Cys Csa NMe-Leu Cys Cys Asn Pro Ala Cys Ala Gly Cys Tyr |
| SEQ ID NO: 660 | Mpr Cys Csa Leu Cys Cys Asn Dhp Ala Cys Ala Gly Cys Tyr |
| SEQ ID NO: 661 | Mpr Cys Csa Leu Cys Cys Asn Thz Ala Cys Ala Gly Cys Tyr |
| SEQ ID NO: 662 | Mpr Cys Csa Leu Cys Cys Asn HyPro Ala Cys Ala Gly Cys Tyr |
| SEQ ID NO: 663 | Mpr Cys Csa Leu Cys Cys Asn Pip Ala Cys Ala Gly Cys Tyr |
| SEQ ID NO: 664 | Mpr Cys Csa Leu Cys Cys Asn Ile Ala Cys Ala Gly Cys Tyr |
| SEQ ID NO: 665 | Mpr Cys Csa Leu Cys Cys Asn Ala Ala Cys Ala Gly Cys Tyr |
| SEQ ID NO: 666 | Mpr Cys Csa Leu Cys Cys Asn Pro Ala Cys Thr Gly Cys Tyr |
| SEQ ID NO: 667 | Mpr Cys Csa Leu Cys Cys Asn Pro Ala Cys Ser Gly Cys Tyr |
| SEQ ID NO: 668 | Mpr Cys Csa Leu Cys Cys Asn Pro Ala Cys 4F-Phe Gly Cys Tyr |
| SEQ ID NO: 669 | Mpr Cys Csa Leu Cys Cys Asn Pro Ala Cys 4MeO-Phe Gly Cys Tyr |
| SEQ ID NO: 670 | Mpr Cys Csa Leu Cys Cys Asn Pro Ala Cys 4NO2-Phe Gly Cys Tyr |
| SEQ ID NO: 671 | Mpr Cys Csa Leu Cys Cys Asn Pro Ala Cys 5F-Phe Gly Cys Tyr |
| SEQ ID NO: 672 | Mpr Cys Csa Leu Cys Cys Asn Pro Ala Cys 4MeF3-Phe Gly Cys Tyr |
| SEQ ID NO: 673 | Mpr Cys Csa Leu Cys Cys Asn Pro Ala Cys Ala D-Ala Cys Tyr |
| SEQ ID NO: 674 | Mpr Cys Csa Leu Cys Cys Asn Pro Ala Cys Ala Gly Cys Ile |
| SEQ ID NO: 675 | Mpr Cys Csa Leu Cys Cys Asn Pro Ala Cys Ala Gly Cys Trp |
| SEQ ID NO: 676 | Mpr Cys Glu Thr Cys Cys Asn Dhp Ala Cys Ala Gly Cys Tyr |
| SEQ ID NO: 677 | Mpr Cys Glu Thr Cys Cys Asn Thz Ala Cys Ala Gly Cys Tyr |
| SEQ ID NO: 678 | Mpr Cys Glu Thr Cys Cys Asn HyPro Ala Cys Ala Gly Cys Tyr |
| SEQ ID NO: 679 | Mpr Cys Glu Thr Cys Cys Asn Pip Ala Cys Ala Gly Cys Tyr |
| SEQ ID NO: 680 | Mpr Cys Glu Thr Cys Cys Asn Ile Ala Cys Ala Gly Cys Tyr |
| SEQ ID NO: 681 | Mpr Cys Glu Thr Cys Cys Asn Ala Ala Cys Ala Gly Cys Tyr |
| SEQ ID NO: 682 | Mpr Cys Glu hLeu Cys Cys Asn Dhp Ala Cys Ala Gly Cys Tyr |
| SEQ ID NO: 683 | Mpr Cys Glu hLeu Cys Cys Asn Thz Ala Cys Ala Gly Cys Tyr |
| SEQ ID NO: 684 | Mpr Cys Glu hLeu Cys Cys Asn HyPro Ala Cys Ala Gly Cys Tyr |

TABLE 3C-continued

Triple substitutions from Scheme 1

| | |
|---|---|
| SEQ ID NO: 685 | Mpr Cys Glu hLeu Cys Cys Asn Pip Ala Cys Ala Gly Cys Tyr |
| SEQ ID NO: 686 | Mpr Cys Glu hLeu Cys Cys Asn Ile Ala Cys Ala Gly Cys Tyr |
| SEQ ID NO: 687 | Mpr Cys Glu hLeu Cys Cys Asn Ala Ala Cys Ala Gly Cys Tyr |
| SEQ ID NO: 688 | Mpr Cys Glu norLeu Cys Cys Asn Dhp Ala Cys Ala Gly Cys Tyr |
| SEQ ID NO: 689 | Mpr Cys Glu norLeu Cys Cys Asn Thz Ala Cys Ala Gly Cys Tyr |
| SEQ ID NO: 690 | Mpr Cys Glu norLeu Cys Cys Asn HyPro Ala Cys Ala Gly Cys Tyr |
| SEQ ID NO: 691 | Mpr Cys Glu norLeu Cys Cys Asn Pip Ala Cys Ala Gly Cys Tyr |
| SEQ ID NO: 692 | Mpr Cys Glu norLeu Cys Cys Asn Ile Ala Cys Ala Gly Cys Tyr |
| SEQ ID NO: 693 | Mpr Cys Glu norLeu Cys Cys Asn Ala Ala Cys Ala Gly Cys Tyr |
| SEQ ID NO: 694 | Mpr Cys Glu ChxAla Cys Cys Asn Dhp Ala Cys Ala Gly Cys Tyr |
| SEQ ID NO: 695 | Mpr Cys Glu ChxAla Cys Cys Asn Thz Ala Cys Ala Gly Cys Tyr |
| SEQ ID NO: 696 | Mpr Cys Glu ChxAla Cys Cys Asn HyPro Ala Cys Ala Gly Cys Tyr |
| SEQ ID NO: 697 | Mpr Cys Glu ChxAla Cys Cys Asn Pip Ala Cys Ala Gly Cys Tyr |
| SEQ ID NO: 698 | Mpr Cys Glu ChxAla Cys Cys Asn Ile Ala Cys Ala Gly Cys Tyr |
| SEQ ID NO: 699 | Mpr Cys Glu ChxAla Cys Cys Asn Ala Ala Cys Ala Gly Cys Tyr |
| SEQ ID NO: 700 | Mpr Cys Glu ChxIle Cys Cys Asn Dhp Ala Cys Ala Gly Cys Tyr |
| SEQ ID NO: 701 | Mpr Cys Glu ChxIle Cys Cys Asn Thz Ala Cys Ala Gly Cys Tyr |
| SEQ ID NO: 702 | Mpr Cys Glu ChxIle Cys Cys Asn HyPro Ala Cys Ala Gly Cys Tyr |
| SEQ ID NO: 703 | Mpr Cys Glu ChxIle Cys Cys Asn Pip Ala Cys Ala Gly Cys Tyr |
| SEQ ID NO: 704 | Mpr Cys Glu ChxIle Cys Cys Asn Ile Ala Cys Ala Gly Cys Tyr |
| SEQ ID NO: 705 | Mpr Cys Glu ChxIle Cys Cys Asn Ala Ala Cys Ala Gly Cys Tyr |
| SEQ ID NO: 706 | Mpr Cys Glu Phe Cys Cys Asn Dhp Ala Cys Ala Gly Cys Tyr |
| SEQ ID NO: 707 | Mpr Cys Glu Phe Cys Cys Asn Thz Ala Cys Ala Gly Cys Tyr |
| SEQ ID NO: 708 | Mpr Cys Glu Phe Cys Cys Asn HyPro Ala Cys Ala Gly Cys Tyr |
| SEQ ID NO: 709 | Mpr Cys Glu Phe Cys Cys Asn Pip Ala Cys Ala Gly Cys Tyr |
| SEQ ID NO: 710 | Mpr Cys Glu Phe Cys Cys Asn Ile Ala Cys Ala Gly Cys Tyr |
| SEQ ID NO: 711 | Mpr Cys Glu Phe Cys Cys Asn Ala Ala Cys Ala Gly Cys Tyr |
| SEQ ID NO: 712 | Mpr Cys Glu Tyr Cys Cys Asn Dhp Ala Cys Ala Gly Cys Tyr |
| SEQ ID NO: 713 | Mpr Cys Glu Tyr Cys Cys Asn Thz Ala Cys Ala Gly Cys Tyr |
| SEQ ID NO: 714 | Mpr Cys Glu Tyr Cys Cys Asn HyPro Ala Cys Ala Gly Cys Tyr |
| SEQ ID NO: 715 | Mpr Cys Glu Tyr Cys Cys Asn Pip Ala Cys Ala Gly Cys Tyr |
| SEQ ID NO: 716 | Mpr Cys Glu Tyr Cys Cys Asn Ile Ala Cys Ala Gly Cys Tyr |
| SEQ ID NO: 717 | Mpr Cys Glu Tyr Cys Cys Asn Ala Ala Cys Ala Gly Cys Tyr |
| SEQ ID NO: 718 | Mpr Cys Glu Dopa Cys Cys Asn Dhp Ala Cys Ala Gly Cys Tyr |
| SEQ ID NO: 719 | Mpr Cys Glu Dopa Cys Cys Asn Thz Ala Cys Ala Gly Cys Tyr |
| SEQ ID NO: 720 | Mpr Cys Glu Dopa Cys Cys Asn HyPro Ala Cys Ala Gly Cys Tyr |
| SEQ ID NO: 721 | Mpr Cys Glu Dopa Cys Cys Asn Pip Ala Cys Ala Gly Cys Tyr |
| SEQ ID NO: 722 | Mpr Cys Glu Dopa Cys Cys Asn Ile Ala Cys Ala Gly Cys Tyr |
| SEQ ID NO: 723 | Mpr Cys Glu Dopa Cys Cys Asn Ala Ala Cys Ala Gly Cys Tyr |

TABLE 3C-continued

Triple substitutions from Scheme 1

| | |
|---|---|
| SEQ ID NO: 724 | Mpr Cys Glu NMe-Leu Cys Cys Asn Dhp Ala Cys Ala Gly Cys Tyr |
| SEQ ID NO: 725 | Mpr Cys Glu NMe-Leu Cys Cys Asn Thz Ala Cys Ala Gly Cys Tyr |
| SEQ ID NO: 726 | Mpr Cys Glu NMe-Leu Cys Cys Asn HyPro Ala Cys Ala Gly Cys Tyr |
| SEQ ID NO: 727 | Mpr Cys Glu NMe-Leu Cys Cys Asn Pip Ala Cys Ala Gly Cys Tyr |
| SEQ ID NO: 728 | Mpr Cys Glu NMe-Leu Cys Cys Asn Ile Ala Cys Ala Gly Cys Tyr |
| SEQ ID NO: 729 | Mpr Cys Glu NMe-Leu Cys Cys Asn Ala Ala Cys Ala Gly Cys Tyr |
| SEQ ID NO: 730 | Mpr Cys Glu Thr Cys Cys Asn Pro Ala Cys Thr Gly Cys Tyr |
| SEQ ID NO: 731 | Mpr Cys Glu Thr Cys Cys Asn Pro Ala Cys Ser Gly Cys Tyr |
| SEQ ID NO: 732 | Mpr Cys Glu Thr Cys Cys Asn Pro Ala Cys 4F-Phe Gly Cys Tyr |
| SEQ ID NO: 733 | Mpr Cys Glu Thr Cys Cys Asn Pro Ala Cys 4MeO-Phe Gly Cys Tyr |
| SEQ ID NO: 734 | Mpr Cys Glu Thr Cys Cys Asn Pro Ala Cys 4NO2-Phe Gly Cys Tyr |
| SEQ ID NO: 735 | Mpr Cys Glu Thr Cys Cys Asn Pro Ala Cys 5F-Phe Gly Cys Tyr |
| SEQ ID NO: 736 | Mpr Cys Glu Thr Cys Cys Asn Pro Ala Cys 4MeF3-Phe Gly Cys Tyr |
| SEQ ID NO: 737 | Mpr Cys Glu hLeu Cys Cys Asn Pro Ala Cys Ser Gly Cys Tyr |
| SEQ ID NO: 738 | Mpr Cys Glu hLeu Cys Cys Asn Pro Ala Cys 4F-Phe Gly Cys Tyr |
| SEQ ID NO: 739 | Mpr Cys Glu hLeu Cys Cys Asn Pro Ala Cys 4MeO-Phe Gly Cys Tyr |
| SEQ ID NO: 740 | Mpr Cys Glu hLeu Cys Cys Asn Pro Ala Cys 4NO2-Phe Gly Cys Tyr |
| SEQ ID NO: 741 | Mpr Cys Glu hLeu Cys Cys Asn Pro Ala Cys 5F-Phe Gly Cys Tyr |
| SEQ ID NO: 742 | Mpr Cys Glu hLeu Cys Cys Asn Pro Ala Cys 4MeF3-Phe Gly Cys Tyr |
| SEQ ID NO: 743 | Mpr Cys Glu norLeu Cys Cys Asn Pro Ala Cys Thr Gly Cys Tyr |
| SEQ ID NO: 744 | Mpr Cys Glu norLeu Cys Cys Asn Pro Ala Cys Ser Gly Cys Tyr |
| SEQ ID NO: 745 | Mpr Cys Glu norLeu Cys Cys Asn Pro Ala Cys 4F-Phe Gly Cys Tyr |
| SEQ ID NO: 746 | Mpr Cys Glu norLeu Cys Cys Asn Pro Ala Cys 4MeO-Phe Gly Cys Tyr |
| SEQ ID NO: 747 | Mpr Cys Glu norLeu Cys Cys Asn Pro Ala Cys 4NO2-Phe Gly Cys Tyr |
| SEQ ID NO: 748 | Mpr Cys Glu norLeu Cys Cys Asn Pro Ala Cys 5F-Phe Gly Cys Tyr |
| SEQ ID NO: 749 | Mpr Cys Glu norLeu Cys Cys Asn Pro Ala Cys 4MeF3-Phe Gly Cys Tyr |
| SEQ ID NO: 750 | Mpr Cys Glu norLeu Cys Cys Asn Pro Ala Cys Thr Gly Cys Tyr |
| SEQ ID NO: 751 | Mpr Cys Glu ChxAla Cys Cys Asn Pro Ala Cys Ser Gly Cys Tyr |
| SEQ ID NO: 752 | Mpr Cys Glu ChxAla Cys Cys Asn Pro Ala Cys 4F-Phe Gly Cys Tyr |
| SEQ ID NO: 753 | Mpr Cys Glu ChxAla Cys Cys Asn Pro Ala Cys 4MeO-Phe Gly Cys Tyr |
| SEQ ID NO: 754 | Mpr Cys Glu ChxAla Cys Cys Asn Pro Ala Cys 4NO2-Phe Gly Cys Tyr |
| SEQ ID NO: 755 | Mpr Cys Glu ChxAla Cys Cys Asn Pro Ala Cys 5F-Phe Gly Cys Tyr |
| SEQ ID NO: 756 | Mpr Cys Glu ChxAla Cys Cys Asn Pro Ala Cys 4MeF3-Phe Gly Cys Tyr |
| SEQ ID NO: 757 | Mpr Cys Glu ChxIle Cys Cys Asn Pro Ala Cys Thr Gly Cys Tyr |
| SEQ ID NO: 758 | Mpr Cys Glu ChxIle Cys Cys Asn Pro Ala Cys Ser Gly Cys Tyr |
| SEQ ID NO: 759 | Mpr Cys Glu ChxIle Cys Cys Asn Pro Ala Cys 4F-Phe Gly Cys Tyr |
| SEQ ID NO: 760 | Mpr Cys Glu ChxIle Cys Cys Asn Pro Ala Cys 4MeO-Phe Gly Cys Tyr |
| SEQ ID NO: 761 | Mpr Cys Glu ChxIle Cys Cys Asn Pro Ala Cys 4NO2-Phe Gly Cys Tyr |
| SEQ ID NO: 762 | Mpr Cys Glu ChxIle Cys Cys Asn Pro Ala Cys 5F-Phe Gly Cys Tyr |

TABLE 3C-continued

Triple substitutions from Scheme 1

SEQ ID NO: 763  Mpr Cys Glu ChxIle Cys Cys Asn Pro Ala Cys 4MeF3-Phe Gly Cys Tyr
SEQ ID NO: 764  Mpr Cys Glu Phe Cys Cys Asn Pro Ala Cys Thr Gly Cys Tyr
SEQ ID NO: 765  Mpr Cys Glu Phe Cys Cys Asn Pro Ala Cys Ser Gly Cys Tyr
SEQ ID NO: 766  Mpr Cys Glu Phe Cys Cys Asn Pro Ala Cys 4F-Phe Gly Cys Tyr
SEQ ID NO: 767  Mpr Cys Glu Phe Cys Cys Asn Pro Ala Cys 4MeO-Phe Gly Cys Tyr
SEQ ID NO: 768  Mpr Cys Glu Phe Cys Cys Asn Pro Ala Cys 4NO2-Phe Gly Cys Tyr
SEQ ID NO: 769  Mpr Cys Glu Phe Cys Cys Asn Pro Ala Cys 5F-Phe Gly Cys Tyr
SEQ ID NO: 770  Mpr Cys Glu Phe Cys Cys Asn Pro Ala Cys 4MeF3-Phe Gly Cys Tyr
SEQ ID NO: 771  Mpr Cys Glu Tyr Cys Cys Asn Pro Ala Cys Thr Gly Cys Tyr
SEQ ID NO: 772  Mpr Cys Glu Tyr Cys Cys Asn Pro Ala Cys Ser Gly Cys Tyr
SEQ ID NO: 773  Mpr Cys Glu Tyr Cys Cys Asn Pro Ala Cys 4F-Phe Gly Cys Tyr
SEQ ID NO: 774  Mpr Cys Glu Tyr Cys Cys Asn Pro Ala Cys 4MeO-Phe Gly Cys Tyr
SEQ ID NO: 775  Mpr Cys Glu Tyr Cys Cys Asn Pro Ala Cys 4NO2-Phe Gly Cys Tyr
SEQ ID NO: 776  Mpr Cys Glu Tyr Cys Cys Asn Pro Ala Cys 5F-Phe Gly Cys Tyr
SEQ ID NO: 777  Mpr Cys Glu Tyr Cys Cys Asn Pro Ala Cys 4MeF3-Phe Gly Cys Tyr
SEQ ID NO: 778  Mpr Cys Glu Dopa Cys Cys Asn Pro Ala Cys Thr Gly Cys Tyr
SEQ ID NO: 779  Mpr Cys Glu Dopa Cys Cys Asn Pro Ala Cys Ser Gly Cys Tyr
SEQ ID NO: 780  Mpr Cys Glu Dopa Cys Cys Asn Pro Ala Cys 4F-Phe Gly Cys Tyr
SEQ ID NO: 781  Mpr Cys Glu Dopa Cys Cys Asn Pro Ala Cys 4MeO-Phe Gly Cys Tyr
SEQ ID NO: 782  Mpr Cys Glu Dopa Cys Cys Asn Pro Ala Cys 4NO2-Phe Gly Cys Tyr
SEQ ID NO: 783  Mpr Cys Glu Dopa Cys Cys Asn Pro Ala Cys 5F-Phe Gly Cys Tyr
SEQ ID NO: 784  Mpr Cys Glu Dopa Cys Cys Asn Pro Ala Cys 4MeF3-Phe Gly Cys Tyr
SEQ ID NO: 785  Mpr Cys Glu NMe-Leu Cys Cys Asn Pro Ala Cys Thr Gly Cys Tyr
SEQ ID NO: 786  Mpr Cys Glu NMe-Leu Cys Cys Asn Pro Ala Cys Ser Gly Cys Tyr
SEQ ID NO: 787  Mpr Cys Glu NMe-Leu Cys Cys Asn Pro Ala Cys 4F-Phe Gly Cys Tyr
SEQ ID NO: 788  Mpr Cys Glu NMe-Leu Cys Cys Asn Pro Ala Cys 4MeO-Phe Gly Cys Tyr
SEQ ID NO: 789  Mpr Cys Glu NMe-Leu Cys Cys Asn Pro Ala Cys 4NO2-Phe Gly Cys Tyr
SEQ ID NO: 790  Mpr Cys Glu NMe-Leu Cys Cys Asn Pro Ala Cys 5F-Phe Gly Cys Tyr
SEQ ID NO: 791  Mpr Cys Glu NMe-Leu Cys Cys Asn Pro Ala Cys 4MeF3-Phe Gly Cys Tyr
SEQ ID NO: 792  Mpr Cys Glu Thr Cys Cys Asn Pro Ala Cys Ala D-Ala Cys Tyr
SEQ ID NO: 793  Mpr Cys Glu hLeu Cys Cys Asn Pro Ala Cys Ala D-Ala Cys Tyr
SEQ ID NO: 794  Mpr Cys Glu norLeu Cys Cys Asn Pro Ala Cys Ala D-Ala Cys Tyr
SEQ ID NO: 795  Mpr Cys Glu ChxAla Cys Cys Asn Pro Ala Cys Ala D-Ala Cys Tyr
SEQ ID NO: 796  Mpr Cys Glu ChxIle Cys Cys Asn Pro Ala Cys Ala D-Ala Cys Tyr
SEQ ID NO: 797  Mpr Cys Glu Phe Cys Cys Asn Pro Ala Cys Ala D-Ala Cys Tyr
SEQ ID NO: 798  Mpr Cys Glu Tyr Cys Cys Asn Pro Ala Cys Ala D-Ala Cys Tyr
SEQ ID NO: 799  Mpr Cys Glu Dopa Cys Cys Asn Pro Ala Cys Ala D-Ala Cys Tyr
SEQ ID NO: 800  Mpr Cys Glu NMe-Leu Cys Cys Asn Pro Ala Cys Ala D-Ala Cys Tyr
SEQ ID NO: 801  Mpr Cys Glu Thr Cys Cys Asn Pro Ala Cys Ala Gly Cys Ile TABLE 3C-continued

| Triple substitutions from Scheme 1 |
|---|
| SEQ ID NO: 802   Mpr Cys Glu Thr Cys Cys Asn Pro Ala Cys Ala Gly Cys Trp |
| SEQ ID NO: 803   Mpr Cys Glu hLeu Cys Cys Asn Pro Ala Cys Ala Gly Cys Ile |
| SEQ ID NO: 804   Mpr Cys Glu hLeu Cys Cys Asn Pro Ala Cys Ala Gly Cys Trp |
| SEQ ID NO: 805   Mpr Cys Glu norLeu Cys Cys Asn Pro Ala Cys Ala Gly Cys Ile |
| SEQ ID NO: 806   Mpr Cys Glu norLeu Cys Cys Asn Pro Ala Cys Ala Gly Cys Trp |
| SEQ ID NO: 807   Mpr Cys Glu ChxAla Cys Cys Asn Pro Ala Cys Ala Gly Cys Ile |
| SEQ ID NO: 808   Mpr Cys Glu ChxAla Cys Cys Asn Pro Ala Cys Ala Gly Cys Trp |
| SEQ ID NO: 809   Mpr Cys Glu ChxIle Cys Cys Asn Pro Ala Cys Ala Gly Cys Ile |
| SEQ ID NO: 810   Mpr Cys Glu ChxIle Cys Cys Asn Pro Ala Cys Ala Gly Cys Trp |
| SEQ ID NO: 811   Mpr Cys Glu Phe Cys Cys Asn Pro Ala Cys Ala Gly Cys Ile |
| SEQ ID NO: 812   Mpr Cys Glu Phe Cys Cys Asn Pro Ala Cys Ala Gly Cys Trp |
| SEQ ID NO: 813   Mpr Cys Glu Tyr Cys Cys Asn Pro Ala Cys Ala Gly Cys Ile |
| SEQ ID NO: 814   Mpr Cys Glu Tyr Cys Cys Asn Pro Ala Cys Ala Gly Cys Trp |
| SEQ ID NO: 815   Mpr Cys Glu Dopa Cys Cys Asn Pro Ala Cys Ala Gly Cys Ile |
| SEQ ID NO: 816   Mpr Cys Glu Dopa Cys Cys Asn Pro Ala Cys Ala Gly Cys Trp |
| SEQ ID NO: 817   Mpr Cys Glu NMe-Leu Cys Cys Asn Pro Ala Cys Ala Gly Cys Ile |
| SEQ ID NO: 818   Mpr Cys Glu NMe-Leu Cys Cys Asn Pro Ala Cys Ala Gly Cys Trp |
| SEQ ID NO: 819   Mpr Cys Glu Leu Cys Cys Asn Dhp Ala Cys Thr Gly Cys Tyr |
| SEQ ID NO: 820   Mpr Cys Glu Leu Cys Cys Asn Dhp Ala Cys Ser Gly Cys Tyr |
| SEQ ID NO: 821   Mpr Cys Glu Leu Cys Cys Asn Dhp Ala Cys 4F-Phe Gly Cys Tyr |
| SEQ ID NO: 822   Mpr Cys Glu Leu Cys Cys Asn Dhp Ala Cys 4MeO-Phe Gly Cys Tyr |
| SEQ ID NO: 823   Mpr Cys Glu Leu Cys Cys Asn Dhp Ala Cys 4NO2-Phe Gly Cys Tyr |
| SEQ ID NO: 824   Mpr Cys Glu Leu Cys Cys Asn Dhp Ala Cys 5F-Phe Gly Cys Tyr |
| SEQ ID NO: 825   Mpr Cys Glu Leu Cys Cys Asn Dhp Ala Cys 4MeF3-Phe Gly Cys Tyr |
| SEQ ID NO: 826   Mpr Cys Glu Leu Cys Cys Asn Thz Ala Cys Thr Gly Cys Tyr |
| SEQ ID NO: 827   Mpr Cys Glu Leu Cys Cys Asn Thz Ala Cys Ser Gly Cys Tyr |
| SEQ ID NO: 828   Mpr Cys Glu Leu Cys Cys Asn Thz Ala Cys 4F-Phe Gly Cys Tyr |
| SEQ ID NO: 829   Mpr Cys Glu Leu Cys Cys Asn Thz Ala Cys 4MeO-Phe Gly Cys Tyr |
| SEQ ID NO: 830   Mpr Cys Glu Leu Cys Cys Asn Thz Ala Cys 4NO2-Phe Gly Cys Tyr |
| SEQ ID NO: 831   Mpr Cys Glu Leu Cys Cys Asn Thz Ala Cys 5F-Phe Gly Cys Tyr |
| SEQ ID NO: 832   Mpr Cys Glu Leu Cys Cys Asn Thz Ala Cys 4MeF3-Phe Gly Cys Tyr |
| SEQ ID NO: 833   Mpr Cys Glu Leu Cys Cys Asn HyPro Ala Cys Thr Gly Cys Tyr |
| SEQ ID NO: 834   Mpr Cys Glu Leu Cys Cys Asn HyPro Ala Cys Ser Gly Cys Tyr |
| SEQ ID NO: 835   Mpr Cys Glu Leu Cys Cys Asn HyPro Ala Cys 4F-Phe Gly Cys Tyr |
| SEQ ID NO: 836   Mpr Cys Glu Leu Cys Cys Asn HyPro Ala Cys 4MeO-Phe Gly Cys Tyr |
| SEQ ID NO: 837   Mpr Cys Glu Leu Cys Cys Asn HyPro Ala Cys 4NO2-Phe Gly Cys Tyr |
| SEQ ID NO: 838   Mpr Cys Glu Leu Cys Cys Asn HyPro Ala Cys 5F-Phe Gly Cys Tyr |
| SEQ ID NO: 839   Mpr Cys Glu Leu Cys Cys Asn HyPro Ala Cys 4MeF3-Phe Gly Cys Tyr |
| SEQ ID NO: 840   Mpr Cys Glu Leu Cys Cys Asn Pip Ala Cys Thr Gly Cys Tyr |

TABLE 3C-continued

Triple substitutions from Scheme 1

| | |
|---|---|
| SEQ ID NO: 841 | Mpr Cys Glu Leu Cys Cys Asn Pip Ala Cys Ser Gly Cys Tyr |
| SEQ ID NO: 842 | Mpr Cys Glu Leu Cys Cys Asn Pip Ala Cys 4F-Phe Gly Cys Tyr |
| SEQ ID NO: 843 | Mpr Cys Glu Leu Cys Cys Asn Pip Ala Cys 4MeO-Phe Gly Cys Tyr |
| SEQ ID NO: 844 | Mpr Cys Glu Leu Cys Cys Asn Pip Ala Cys 4NO2-Phe Gly Cys Tyr |
| SEQ ID NO: 845 | Mpr Cys Glu Leu Cys Cys Asn Pip Ala Cys 5F-Phe Gly Cys Tyr |
| SEQ ID NO: 846 | Mpr Cys Glu Leu Cys Cys Asn Pip Ala Cys 4MeF3-Phe Gly Cys Tyr |
| SEQ ID NO: 847 | Mpr Cys Glu Leu Cys Cys Asn Ile Ala Cys Thr Gly Cys Tyr |
| SEQ ID NO: 848 | Mpr Cys Glu Leu Cys Cys Asn Ile Ala Cys Ser Gly Cys Tyr |
| SEQ ID NO: 849 | Mpr Cys Glu Leu Cys Cys Asn Ile Ala Cys 4F-Phe Gly Cys Tyr |
| SEQ ID NO: 850 | Mpr Cys Glu Leu Cys Cys Asn Ile Ala Cys 4MeO-Phe Gly Cys Tyr |
| SEQ ID NO: 851 | Mpr Cys Glu Leu Cys Cys Asn Ile Ala Cys 4NO2-Phe Gly Cys Tyr |
| SEQ ID NO: 852 | Mpr Cys Glu Leu Cys Cys Asn Ile Ala Cys 5F-Phe Gly Cys Tyr |
| SEQ ID NO: 853 | Mpr Cys Glu Leu Cys Cys Asn Ile Ala Cys 4MeF3-Phe Gly Cys Tyr |
| SEQ ID NO: 854 | Mpr Cys Glu Leu Cys Cys Asn Ala Ala Cys Thr Gly Cys Tyr |
| SEQ ID NO: 855 | Mpr Cys Glu Leu Cys Cys Asn Ala Ala Cys Ser Gly Cys Tyr |
| SEQ ID NO: 856 | Mpr Cys Glu Leu Cys Cys Asn Ala Ala Cys 4F-Phe Gly Cys Tyr |
| SEQ ID NO: 857 | Mpr Cys Glu Leu Cys Cys Asn Ala Ala Cys 4MeO-Phe Gly Cys Tyr |
| SEQ ID NO: 858 | Mpr Cys Glu Leu Cys Cys Asn Ala Ala Cys 4NO2-Phe Gly Cys Tyr |
| SEQ ID NO: 859 | Mpr Cys Glu Leu Cys Cys Asn Ala Ala Cys 5F-Phe Gly Cys Tyr |
| SEQ ID NO: 860 | Mpr Cys Glu Leu Cys Cys Asn Ala Ala Cys 4MeF3-Phe Gly Cys Tyr |
| SEQ ID NO: 861 | Mpr Cys Glu Leu Cys Cys Asn Dhp Ala Cys Ala D-Ala Cys Tyr |
| SEQ ID NO: 862 | Mpr Cys Glu Leu Cys Cys Asn Thz Ala Cys Ala D-Ala Cys Tyr |
| SEQ ID NO: 863 | Mpr Cys Glu Leu Cys Cys Asn HyPro Ala Cys Ala D-Ala Cys Tyr |
| SEQ ID NO: 864 | Mpr Cys Glu Leu Cys Cys Asn Pip Ala Cys Ala D-Ala Cys Tyr |
| SEQ ID NO: 865 | Mpr Cys Glu Leu Cys Cys Asn Ile Ala Cys Ala D-Ala Cys Tyr |
| SEQ ID NO: 866 | Mpr Cys Glu Leu Cys Cys Asn Ala Ala Cys Ala D-Ala Cys Tyr |
| SEQ ID NO: 867 | Mpr Cys Glu Leu Cys Cys Asn Dhp Ala Cys Ala Gly Cys Ile |
| SEQ ID NO: 868 | Mpr Cys Glu Leu Cys Cys Asn Thz Ala Cys Ala Gly Cys Ile |
| SEQ ID NO: 869 | Mpr Cys Glu Leu Cys Cys Asn HyPro Ala Cys Ala Gly Cys Ile |
| SEQ ID NO: 870 | Mpr Cys Glu Leu Cys Cys Asn Pip Ala Cys Ala Gly Cys Ile |
| SEQ ID NO: 871 | Mpr Cys Glu Leu Cys Cys Asn Ile Ala Cys Ala Gly Cys Ile |
| SEQ ID NO: 872 | Mpr Cys Glu Leu Cys Cys Asn Ala Ala Cys Ala Gly Cys Ile |
| SEQ ID NO: 873 | Mpr Cys Glu Leu Cys Cys Asn Dhp Ala Cys Ala Gly Cys Trp |
| SEQ ID NO: 874 | Mpr Cys Glu Leu Cys Cys Asn Thz Ala Cys Ala Gly Cys Trp |
| SEQ ID NO: 875 | Mpr Cys Glu Leu Cys Cys Asn HyPro Ala Cys Ala Gly Cys Trp |
| SEQ ID NO: 876 | Mpr Cys Glu Leu Cys Cys Asn Pip Ala Cys Ala Gly Cys Trp |
| SEQ ID NO: 877 | Mpr Cys Glu Leu Cys Cys Asn Ile Ala Cys Ala Gly Cys Trp |
| SEQ ID NO: 878 | Mpr Cys Glu Leu Cys Cys Asn Ala Ala Cys Ala Gly Cys Trp |
| SEQ ID NO: 879 | Mpr Cys Glu Leu Cys Cys Asn Pro Ala Cys Thr D-Ala Cys Tyr |

TABLE 3C-continued

Triple substitutions from Scheme 1

SEQ ID NO: 880   Mpr Cys Glu Leu Cys Cys Asn Pro Ala Cys Ser D-Ala Cys Tyr
SEQ ID NO: 881   Mpr Cys Glu Leu Cys Cys Asn Pro Ala Cys 4F-Phe D-Ala Cys Tyr
SEQ ID NO: 882   Mpr Cys Glu Leu Cys Cys Asn Pro Ala Cys 4MeO-Phe D-Ala Cys Tyr
SEQ ID NO: 883   Mpr Cys Glu Leu Cys Cys Asn Pro Ala Cys 4NO2-Phe D-Ala Cys Tyr
SEQ ID NO: 884   Mpr Cys Glu Leu Cys Cys Asn Pro Ala Cys 5F-Phe D-Ala Cys Tyr
SEQ ID NO: 885   Mpr Cys Glu Leu Cys Cys Asn Pro Ala Cys 4MeF3-Phe D-Ala Cys Tyr
SEQ ID NO: 886   Mpr Cys Glu Leu Cys Cys Asn Pro Ala Cys Thr Gly Cys Ile
SEQ ID NO: 887   Mpr Cys Glu Leu Cys Cys Asn Pro Ala Cys Ser Gly Cys Ile
SEQ ID NO: 888   Mpr Cys Glu Leu Cys Cys Asn Pro Ala Cys 4F-Phe Gly Cys Ile
SEQ ID NO: 889   Mpr Cys Glu Leu Cys Cys Asn Pro Ala Cys 4MeO-Phe Gly Cys Ile
SEQ ID NO: 890   Mpr Cys Glu Leu Cys Cys Asn Pro Ala Cys 4NO2-Phe Gly Cys Ile
SEQ ID NO: 891   Mpr Cys Glu Leu Cys Cys Asn Pro Ala Cys 5F-Phe Gly Cys Ile
SEQ ID NO: 892   Mpr Cys Glu Leu Cys Cys Asn Pro Ala Cys 4MeF3-Phe Gly Cys Ile
SEQ ID NO: 893   Mpr Cys Glu Leu Cys Cys Asn Pro Ala Cys Thr Gly Cys Trp
SEQ ID NO: 894   Mpr Cys Glu Leu Cys Cys Asn Pro Ala Cys Ser Gly Cys Trp
SEQ ID NO: 895   Mpr Cys Glu Leu Cys Cys Asn Pro Ala Cys 4F-Phe Gly Cys Trp
SEQ ID NO: 896   Mpr Cys Glu Leu Cys Cys Asn Pro Ala Cys 4MeO-Phe Gly Cys Trp
SEQ ID NO: 897   Mpr Cys Glu Leu Cys Cys Asn Pro Ala Cys 4NO2-Phe Gly Cys Trp
SEQ ID NO: 898   Mpr Cys Glu Leu Cys Cys Asn Pro Ala Cys 5F-Phe Gly Cys Trp
SEQ ID NO: 899   Mpr Cys Glu Leu Cys Cys Asn Pro Ala Cys 4MeF3-Phe Gly Cys Trp
SEQ ID NO: 900   Mpr Cys Glu Leu Cys Cys Asn Pro Ala Cys Ala D-Ala Cys Ile
SEQ ID NO: 901   Mpr Cys Glu Leu Cys Cys Asn Pro Ala Cys Ala D-Ala Cys Trp
SEQ ID NO: 902   Cys Cys Ser Thr Cys Cys Asn Dhp Ala Cys Ala Gly Cys Tyr
SEQ ID NO: 903   Cys Cys Ser Thr Cys Cys Asn Thz Ala Cys Ala Gly Cys Tyr
SEQ ID NO: 904   Cys Cys Ser Thr Cys Cys Asn HyPro Ala Cys Ala Gly Cys Tyr
SEQ ID NO: 905   Cys Cys Ser Thr Cys Cys Asn Pip Ala Cys Ala Gly Cys Tyr
SEQ ID NO: 906   Cys Cys Ser Thr Cys Cys Asn Ile Ala Cys Ala Gly Cys Tyr
SEQ ID NO: 907   Cys Cys Ser Thr Cys Cys Asn Ala Ala Cys Ala Gly Cys Tyr
SEQ ID NO: 908   Cys Cys Ser hLeu Cys Cys Asn Dhp Ala Cys Ala Gly Cys Tyr
SEQ ID NO: 909   Cys Cys Ser hLeu Cys Cys Asn Thz Ala Cys Ala Gly Cys Tyr
SEQ ID NO: 910   Cys Cys Ser hLeu Cys Cys Asn HyPro Ala Cys Ala Gly Cys Tyr
SEQ ID NO: 911   Cys Cys Ser hLeu Cys Cys Asn Pip Ala Cys Ala Gly Cys Tyr
SEQ ID NO: 912   Cys Cys Ser hLeu Cys Cys Asn Ile Ala Cys Ala Gly Cys Tyr
SEQ ID NO: 913   Cys Cys Ser hLeu Cys Cys Asn Ala Ala Cys Ala Gly Cys Tyr
SEQ ID NO: 914   Cys Cys Ser norLeu Cys Cys Asn Dhp Ala Cys Ala Gly Cys Tyr
SEQ ID NO: 915   Cys Cys Ser norLeu Cys Cys Asn Thz Ala Cys Ala Gly Cys Tyr
SEQ ID NO: 916   Cys Cys Ser norLeu Cys Cys Asn HyPro Ala Cys Ala Gly Cys Tyr
SEQ ID NO: 917   Cys Cys Ser norLeu Cys Cys Asn Pip Ala Cys Ala Gly Cys Tyr
SEQ ID NO: 918   Cys Cys Ser norLeu Cys Cys Asn Ile Ala Cys Ala Gly Cys Tyr

TABLE 3C-continued

Triple substitutions from Scheme 1

| | |
|---|---|
| SEQ ID NO: 919 | Cys Cys Ser norLeu Cys Cys Asn Ala Ala Cys Ala Gly Cys Tyr |
| SEQ ID NO: 920 | Cys Cys Ser ChxAla Cys Cys Asn Dhp Ala Cys Ala Gly Cys Tyr |
| SEQ ID NO: 921 | Cys Cys Ser ChxAla Cys Cys Asn Thz Ala Cys Ala Gly Cys Tyr |
| SEQ ID NO: 922 | Cys Cys Ser ChxAla Cys Cys Asn HyPro Ala Cys Ala Gly Cys Tyr |
| SEQ ID NO: 923 | Cys Cys Ser ChxAla Cys Cys Asn Pip Ala Cys Ala Gly Cys Tyr |
| SEQ ID NO: 924 | Cys Cys Ser ChxAla Cys Cys Asn Ile Ala Cys Ala Gly Cys Tyr |
| SEQ ID NO: 925 | Cys Cys Ser ChxAla Cys Cys Asn Ala Ala Cys Ala Gly Cys Tyr |
| SEQ ID NO: 926 | Cys Cys Ser ChxIle Cys Cys Asn Dhp Ala Cys Ala Gly Cys Tyr |
| SEQ ID NO: 927 | Cys Cys Ser ChxIle Cys Cys Asn Thz Ala Cys Ala Gly Cys Tyr |
| SEQ ID NO: 928 | Cys Cys Ser ChxIle Cys Cys Asn HyPro Ala Cys Ala Gly Cys Tyr |
| SEQ ID NO: 929 | Cys Cys Ser ChxIle Cys Cys Asn Pip Ala Cys Ala Gly Cys Tyr |
| SEQ ID NO: 930 | Cys Cys Ser ChxIle Cys Cys Asn Ile Ala Cys Ala Gly Cys Tyr |
| SEQ ID NO: 931 | Cys Cys Ser ChxIle Cys Cys Asn Ala Ala Cys Ala Gly Cys Tyr |
| SEQ ID NO: 932 | Cys Cys Ser Phe Cys Cys Asn Dhp Ala Cys Ala Gly Cys Tyr |
| SEQ ID NO: 933 | Cys Cys Ser Phe Cys Cys Asn Thz Ala Cys Ala Gly Cys Tyr |
| SEQ ID NO: 934 | Cys Cys Ser Phe Cys Cys Asn HyPro Ala Cys Ala Gly Cys Tyr |
| SEQ ID NO: 935 | Cys Cys Ser Phe Cys Cys Asn Pip Ala Cys Ala Gly Cys Tyr |
| SEQ ID NO: 936 | Cys Cys Ser Phe Cys Cys Asn Ile Ala Cys Ala Gly Cys Tyr |
| SEQ ID NO: 937 | Cys Cys Ser Phe Cys Cys Asn Ala Ala Cys Ala Gly Cys Tyr |
| SEQ ID NO: 938 | Cys Cys Ser Tyr Cys Cys Asn Dhp Ala Cys Ala Gly Cys Tyr |
| SEQ ID NO: 939 | Cys Cys Ser Tyr Cys Cys Asn Thz Ala Cys Ala Gly Cys Tyr |
| SEQ ID NO: 940 | Cys Cys Ser Tyr Cys Cys Asn HyPro Ala Cys Ala Gly Cys Tyr |
| SEQ ID NO: 941 | Cys Cys Ser Tyr Cys Cys Asn Pip Ala Cys Ala Gly Cys Tyr |
| SEQ ID NO: 942 | Cys Cys Ser Tyr Cys Cys Asn Ile Ala Cys Ala Gly Cys Tyr |
| SEQ ID NO: 943 | Cys Cys Ser Tyr Cys Cys Asn Ala Ala Cys Ala Gly Cys Tyr |
| SEQ ID NO: 944 | Cys Cys Ser Dopa Cys Cys Asn Dhp Ala Cys Ala Gly Cys Tyr |
| SEQ ID NO: 945 | Cys Cys Ser Dopa Cys Cys Asn Thz Ala Cys Ala Gly Cys Tyr |
| SEQ ID NO: 946 | Cys Cys Ser Dopa Cys Cys Asn HyPro Ala Cys Ala Gly Cys Tyr |
| SEQ ID NO: 947 | Cys Cys Ser Dopa Cys Cys Asn Pip Ala Cys Ala Gly Cys Tyr |
| SEQ ID NO: 948 | Cys Cys Ser Dopa Cys Cys Asn Ile Ala Cys Ala Gly Cys Tyr |
| SEQ ID NO: 949 | Cys Cys Ser Dopa Cys Cys Asn Ala Ala Cys Ala Gly Cys Tyr |
| SEQ ID NO: 950 | Cys Cys Ser NMe-Leu Cys Cys Asn Dhp Ala Cys Ala Gly Cys Tyr |
| SEQ ID NO: 951 | Cys Cys Ser NMe-Leu Cys Cys Asn Thz Ala Cys Ala Gly Cys Tyr |
| SEQ ID NO: 952 | Cys Cys Ser NMe-Leu Cys Cys Asn HyPro Ala Cys Ala Gly Cys Tyr |
| SEQ ID NO: 953 | Cys Cys Ser NMe-Leu Cys Cys Asn Pip Ala Cys Ala Gly Cys Tyr |
| SEQ ID NO: 954 | Cys Cys Ser NMe-Leu Cys Cys Asn Ile Ala Cys Ala Gly Cys Tyr |
| SEQ ID NO: 955 | Cys Cys Ser NMe-Leu Cys Cys Asn Ala Ala Cys Ala Gly Cys Tyr |
| SEQ ID NO: 956 | Cys Cys Ser Thr Cys Cys Asn Pro Ala Cys Thr Gly Cys Tyr |
| SEQ ID NO: 957 | Cys Cys Ser Thr Cys Cys Asn Pro Ala Cys Ser Gly Cys Tyr |

TABLE 3C-continued

Triple substitutions from Scheme 1

| | |
|---|---|
| SEQ ID NO: 958 | Cys Cys Ser Thr Cys Cys Asn Pro Ala Cys 4F-Phe Gly Cys Tyr |
| SEQ ID NO: 959 | Cys Cys Ser Thr Cys Cys Asn Pro Ala Cys 4MeO-Phe Gly Cys Tyr |
| SEQ ID NO: 960 | Cys Cys Ser Thr Cys Cys Asn Pro Ala Cys 4NO2-Phe Gly Cys Tyr |
| SEQ ID NO: 961 | Cys Cys Ser Thr Cys Cys Asn Pro Ala Cys 5F-Phe Gly Cys Tyr |
| SEQ ID NO: 962 | Cys Cys Ser Thr Cys Cys Asn Pro Ala Cys 4MeF3-Phe Gly Cys Tyr |
| SEQ ID NO: 963 | Cys Cys Ser hLeu Cys Cys Asn Pro Ala Cys Thr Gly Cys Tyr |
| SEQ ID NO: 964 | Cys Cys Ser hLeu Cys Cys Asn Pro Ala Cys Ser Gly Cys Tyr |
| SEQ ID NO: 965 | Cys Cys Ser hLeu Cys Cys Asn Pro Ala Cys 4F-Phe Gly Cys Tyr |
| SEQ ID NO: 966 | Cys Cys Ser hLeu Cys Cys Asn Pro Ala Cys 4MeO-Phe Gly Cys Tyr |
| SEQ ID NO: 967 | Cys Cys Ser hLeu Cys Cys Asn Pro Ala Cys 4NO2-Phe Gly Cys Tyr |
| SEQ ID NO: 968 | Cys Cys Ser hLeu Cys Cys Asn Pro Ala Cys 5F-Phe Gly Cys Tyr |
| SEQ ID NO: 969 | Cys Cys Ser hLeu Cys Cys Asn Pro Ala Cys 4MeF3-Phe Gly Cys Tyr |
| SEQ ID NO: 970 | Cys Cys Ser norLeu Cys Cys Asn Pro Ala Cys Thr Gly Cys Tyr |
| SEQ ID NO: 971 | Cys Cys Ser norLeu Cys Cys Asn Pro Ala Cys Ser Gly Cys Tyr |
| SEQ ID NO: 972 | Cys Cys Ser norLeu Cys Cys Asn Pro Ala Cys 4F-Phe Gly Cys Tyr |
| SEQ ID NO: 973 | Cys Cys Ser norLeu Cys Cys Asn Pro Ala Cys 4MeO-Phe Gly Cys Tyr |
| SEQ ID NO: 974 | Cys Cys Ser norLeu Cys Cys Asn Pro Ala Cys 4NO2-Phe Gly Cys Tyr |
| SEQ ID NO: 975 | Cys Cys Ser norLeu Cys Cys Asn Pro Ala Cys 5F-Phe Gly Cys Tyr |
| SEQ ID NO: 976 | Cys Cys Ser norLeu Cys Cys Asn Pro Ala Cys 4MeF3-Phe Gly Cys Tyr |
| SEQ ID NO: 977 | Cys Cys Ser norLeu Cys Cys Asn Pro Ala Cys Thr Gly Cys Tyr |
| SEQ ID NO: 978 | Cys Cys Ser ChxAla Cys Cys Asn Pro Ala Cys Ser Gly Cys Tyr |
| SEQ ID NO: 979 | Cys Cys Ser ChxAla Cys Cys Asn Pro Ala Cys 4F-Phe Gly Cys Tyr |
| SEQ ID NO: 980 | Cys Cys Ser ChxAla Cys Cys Asn Pro Ala Cys 4MeO-Phe Gly Cys Tyr |
| SEQ ID NO: 981 | Cys Cys Ser ChxAla Cys Cys Asn Pro Ala Cys 4NO2-Phe Gly Cys Tyr |
| SEQ ID NO: 982 | Cys Cys Ser ChxAla Cys Cys Asn Pro Ala Cys 5F-Phe Gly Cys Tyr |
| SEQ ID NO: 983 | Cys Cys Ser ChxAla Cys Cys Asn Pro Ala Cys 4MeF3-Phe Gly Cys Tyr |
| SEQ ID NO: 984 | Cys Cys Ser ChxIle Cys Cys Asn Pro Ala Cys Thr Gly Cys Tyr |
| SEQ ID NO: 985 | Cys Cys Ser ChxIle Cys Cys Asn Pro Ala Cys Ser Gly Cys Tyr |
| SEQ ID NO: 986 | Cys Cys Ser ChxIle Cys Cys Asn Pro Ala Cys 4F-Phe Gly Cys Tyr |
| SEQ ID NO: 987 | Cys Cys Ser ChxIle Cys Cys Asn Pro Ala Cys 4MeO-Phe Gly Cys Tyr |
| SEQ ID NO: 988 | Cys Cys Ser ChxIle Cys Cys Asn Pro Ala Cys 4NO2-Phe Gly Cys Tyr |
| SEQ ID NO: 989 | Cys Cys Ser ChxIle Cys Cys Asn Pro Ala Cys 5F-Phe Gly Cys Tyr |
| SEQ ID NO: 990 | Cys Cys Ser ChxIle Cys Cys Asn Pro Ala Cys 4MeF3-Phe Gly Cys Tyr |
| SEQ ID NO: 991 | Cys Cys Ser Phe Cys Cys Asn Pro Ala Cys Thr Gly Cys Tyr |
| SEQ ID NO: 992 | Cys Cys Ser Phe Cys Cys Asn Pro Ala Cys Ser Gly Cys Tyr |
| SEQ ID NO: 993 | Cys Cys Ser Phe Cys Cys Asn Pro Ala Cys 4F-Phe Gly Cys Tyr |
| SEQ ID NO: 994 | Cys Cys Ser Phe Cys Cys Asn Pro Ala Cys 4MeO-Phe Gly Cys Tyr |
| SEQ ID NO: 995 | Cys Cys Ser Phe Cys Cys Asn Pro Ala Cys 4NO2-Phe Gly Cys Tyr |
| SEQ ID NO: 996 | Cys Cys Ser Phe Cys Cys Asn Pro Ala Cys 5F-Phe Gly Cys Tyr |

TABLE 3C-continued

Triple substitutions from Scheme 1

| | |
|---|---|
| SEQ ID NO: 997 | Cys Cys Ser Phe Cys Cys Asn Pro Ala Cys 4MeF3-Phe Gly Cys Tyr |
| SEQ ID NO: 998 | Cys Cys Ser Tyr Cys Cys Asn Pro Ala Cys Thr Gly Cys Tyr |
| SEQ ID NO: 999 | Cys Cys Ser Tyr Cys Cys Asn Pro Ala Cys Ser Gly Cys Tyr |
| SEQ ID NO: 1000 | Cys Cys Ser Tyr Cys Cys Asn Pro Ala Cys 4F-Phe Gly Cys Tyr |
| SEQ ID NO: 1001 | Cys Cys Ser Tyr Cys Cys Asn Pro Ala Cys 4MeO-Phe Gly Cys Tyr |
| SEQ ID NO: 1002 | Cys Cys Ser Tyr Cys Cys Asn Pro Ala Cys 4NO2-Phe Gly Cys Tyr |
| SEQ ID NO: 1003 | Cys Cys Ser Tyr Cys Cys Asn Pro Ala Cys 5F-Phe Gly Cys Tyr |
| SEQ ID NO: 1004 | Cys Cys Ser Tyr Cys Cys Asn Pro Ala Cys 4MeF3-Phe Gly Cys Tyr |
| SEQ ID NO: 1005 | Cys Cys Ser Dopa Cys Cys Asn Pro Ala Cys Thr Gly Cys Tyr |
| SEQ ID NO: 1006 | Cys Cys Ser Dopa Cys Cys Asn Pro Ala Cys Ser Gly Cys Tyr |
| SEQ ID NO: 1007 | Cys Cys Ser Dopa Cys Cys Asn Pro Ala Cys 4F-Phe Gly Cys Tyr |
| SEQ ID NO: 1008 | Cys Cys Ser Dopa Cys Cys Asn Pro Ala Cys 4MeO-Phe Gly Cys Tyr |
| SEQ ID NO: 1009 | Cys Cys Ser Dopa Cys Cys Asn Pro Ala Cys 4NO2-Phe Gly Cys Tyr |
| SEQ ID NO: 1010 | Cys Cys Ser Dopa Cys Cys Asn Pro Ala Cys 5F-Phe Gly Cys Tyr |
| SEQ ID NO: 1011 | Cys Cys Ser Dopa Cys Cys Asn Pro Ala Cys 4MeF3-Phe Gly Cys Tyr |
| SEQ ID NO: 1012 | Cys Cys Ser NMe-Leu Cys Cys Asn Pro Ala Cys Thr Gly Cys Tyr |
| SEQ ID NO: 1013 | Cys Cys Ser NMe-Leu Cys Cys Asn Pro Ala Cys Ser Gly Cys Tyr |
| SEQ ID NO: 1014 | Cys Cys Ser NMe-Leu Cys Cys Asn Pro Ala Cys 4F-Phe Gly Cys Tyr |
| SEQ ID NO: 1015 | Cys Cys Ser NMe-Leu Cys Cys Asn Pro Ala Cys 4MeO-Phe Gly Cys Tyr |
| SEQ ID NO: 1016 | Cys Cys Ser NMe-Leu Cys Cys Asn Pro Ala Cys 4NO2-Phe Gly Cys Tyr |
| SEQ ID NO: 1017 | Cys Cys Ser NMe-Leu Cys Cys Asn Pro Ala Cys 5F-Phe Gly Cys Tyr |
| SEQ ID NO: 1018 | Cys Cys Ser NMe-Leu Cys Cys Asn Pro Ala Cys 4MeF3-Phe Gly Cys Tyr |
| SEQ ID NO: 1019 | Cys Cys Ser Thr Cys Cys Asn Pro Ala Cys Ala D-Ala Cys Tyr |
| SEQ ID NO: 1020 | Cys Cys Ser hLeu Cys Cys Asn Pro Ala Cys Ala D-Ala Cys Tyr |
| SEQ ID NO: 1021 | Cys Cys Ser norLeu Cys Cys Asn Pro Ala Cys Ala D-Ala Cys Tyr |
| SEQ ID NO: 1022 | Cys Cys Ser ChxAla Cys Cys Asn Pro Ala Cys Ala D-Ala Cys Tyr |
| SEQ ID NO: 1023 | Cys Cys Ser ChxIle Cys Cys Asn Pro Ala Cys Ala D-Ala Cys Tyr |
| SEQ ID NO: 1024 | Cys Cys Ser Phe Cys Cys Asn Pro Ala Cys Ala D-Ala Cys Tyr |
| SEQ ID NO: 1025 | Cys Cys Ser Tyr Cys Cys Asn Pro Ala Cys Ala D-Ala Cys Tyr |
| SEQ ID NO: 1026 | Cys Cys Ser Dopa Cys Cys Asn Pro Ala Cys Ala D-Ala Cys Tyr |
| SEQ ID NO: 1027 | Cys Cys Ser NMe-Leu Cys Cys Asn Pro Ala Cys Ala D-Ala Cys Tyr |
| SEQ ID NO: 1028 | Cys Cys Ser Thr Cys Cys Asn Pro Ala Cys Ala Gly Cys Ile |
| SEQ ID NO: 1029 | Cys Cys Ser Thr Cys Cys Asn Pro Ala Cys Ala Gly Cys Trp |
| SEQ ID NO: 1030 | Cys Cys Ser hLeu Cys Cys Asn Pro Ala Cys Ala Gly Cys Ile |
| SEQ ID NO: 1031 | Cys Cys Ser hLeu Cys Cys Asn Pro Ala Cys Ala Gly Cys Trp |
| SEQ ID NO: 1032 | Cys Cys Ser norLeu Cys Cys Asn Pro Ala Cys Ala Gly Cys Ile |
| SEQ ID NO: 1033 | Cys Cys Ser norLeu Cys Cys Asn Pro Ala Cys Ala Gly Cys Trp |
| SEQ ID NO: 1034 | Cys Cys Ser ChxAla Cys Cys Asn Pro Ala Cys Ala Gly Cys Ile |
| SEQ ID NO: 1035 | Cys Cys Ser ChxAla Cys Cys Asn Pro Ala Cys Ala Gly Cys Trp |

TABLE 3C-continued

Triple substitutions from Scheme 1

SEQ ID NO: 1036  Cys Cys Ser ChxIle Cys Cys Asn Pro Ala Cys Ala Gly Cys Ile
SEQ ID NO: 1037  Cys Cys Ser ChxIle Cys Cys Asn Pro Ala Cys Ala Gly Cys Trp
SEQ ID NO: 1038  Cys Cys Ser Phe Cys Cys Asn Pro Ala Cys Ala Gly Cys Ile
SEQ ID NO: 1039  Cys Cys Ser Phe Cys Cys Asn Pro Ala Cys Ala Gly Cys Trp
SEQ ID NO: 1040  Cys Cys Ser Tyr Cys Cys Asn Pro Ala Cys Ala Gly Cys Ile
SEQ ID NO: 1041  Cys Cys Ser Tyr Cys Cys Asn Pro Ala Cys Ala Gly Cys Trp
SEQ ID NO: 1042  Cys Cys Ser Dopa Cys Cys Asn Pro Ala Cys Ala Gly Cys Ile
SEQ ID NO: 1043  Cys Cys Ser Dopa Cys Cys Asn Pro Ala Cys Ala Gly Cys Trp
SEQ ID NO: 1044  Cys Cys Ser NMe-Leu Cys Cys Asn Pro Ala Cys Ala Gly Cys Ile
SEQ ID NO: 1045  Cys Cys Ser NMe-Leu Cys Cys Asn Pro Ala Cys Ala Gly Cys Trp
SEQ ID NO: 1046  Cys Cys hSer Thr Cys Cys Asn Dhp Ala Cys Ala Gly Cys Tyr
SEQ ID NO: 1047  Cys Cys hSer Thr Cys Cys Asn Thz Ala Cys Ala Gly Cys Tyr
SEQ ID NO: 1048  Cys Cys hSer Thr Cys Cys Asn HyPro Ala Cys Ala Gly Cys Tyr
SEQ ID NO: 1049  Cys Cys hSer Thr Cys Cys Asn Pip Ala Cys Ala Gly Cys Tyr
SEQ ID NO: 1050  Cys Cys hSer Thr Cys Cys Asn Ile Ala Cys Ala Gly Cys Tyr
SEQ ID NO: 1051  Cys Cys hSer Thr Cys Cys Asn Ala Ala Cys Ala Gly Cys Tyr
SEQ ID NO: 1052  Cys Cys hSer hLeu Cys Cys Asn Dhp Ala Cys Ala Gly Cys Tyr
SEQ ID NO: 1053  Cys Cys hSer hLeu Cys Cys Asn Thz Ala Cys Ala Gly Cys Tyr
SEQ ID NO: 1054  Cys Cys hSer hLeu Cys Cys Asn HyPro Ala Cys Ala Gly Cys Tyr
SEQ ID NO: 1055  Cys Cys hSer hLeu Cys Cys Asn Pip Ala Cys Ala Gly Cys Tyr
SEQ ID NO: 1056  Cys Cys hSer hLeu Cys Cys Asn Ile Ala Cys Ala Gly Cys Tyr
SEQ ID NO: 1057  Cys Cys hSer hLeu Cys Cys Asn Ala Ala Cys Ala Gly Cys Tyr
SEQ ID NO: 1058  Cys Cys hSer norLeu Cys Cys Asn Dhp Ala Cys Ala Gly Cys Tyr
SEQ ID NO: 1059  Cys Cys hSer norLeu Cys Cys Asn Thz Ala Cys Ala Gly Cys Tyr
SEQ ID NO: 1060  Cys Cys hSer norLeu Cys Cys Asn HyPro Ala Cys Ala Gly Cys Tyr
SEQ ID NO: 1061  Cys Cys hSer norLeu Cys Cys Asn Pip Ala Cys Ala Gly Cys Tyr
SEQ ID NO: 1062  Cys Cys hSer norLeu Cys Cys Asn Ile Ala Cys Ala Gly Cys Tyr
SEQ ID NO: 1063  Cys Cys hSer norLeu Cys Cys Asn Ala Ala Cys Ala Gly Cys Tyr
SEQ ID NO: 1064  Cys Cys hSer ChxAla Cys Cys Asn Dhp Ala Cys Ala Gly Cys Tyr
SEQ ID NO: 1065  Cys Cys hSer ChxAla Cys Cys Asn Thz Ala Cys Ala Gly Cys Tyr
SEQ ID NO: 1066  Cys Cys hSer ChxAla Cys Cys Asn HyPro Ala Cys Ala Gly Cys Tyr
SEQ ID NO: 1067  Cys Cys hSer ChxAla Cys Cys Asn Pip Ala Cys Ala Gly Cys Tyr
SEQ ID NO: 1068  Cys Cys hSer ChxAla Cys Cys Asn Ile Ala Cys Ala Gly Cys Tyr
SEQ ID NO: 1069  Cys Cys hSer ChxAla Cys Cys Asn Ala Ala Cys Ala Gly Cys Tyr
SEQ ID NO: 1070  Cys Cys hSer ChxIle Cys Cys Asn Dhp Ala Cys Ala Gly Cys Tyr
SEQ ID NO: 1071  Cys Cys hSer ChxIle Cys Cys Asn Thz Ala Cys Ala Gly Cys Tyr
SEQ ID NO: 1072  Cys Cys hSer ChxIle Cys Cys Asn HyPro Ala Cys Ala Gly Cys Tyr
SEQ ID NO: 1073  Cys Cys hSer ChxIle Cys Cys Asn Pip Ala Cys Ala Gly Cys Tyr
SEQ ID NO: 1074  Cys Cys hSer ChxIle Cys Cys Asn Ile Ala Cys Ala Gly Cys Tyr TABLE 3C-continued Triple substitutions from Scheme 1

SEQ ID NO: 1075 Cys Cys hSer ChxIle Cys Cys Asn Ala Ala Cys Ala Gly Cys Tyr
SEQ ID NO: 1076 Cys Cys hSer Phe Cys Cys Asn Dhp Ala Cys Ala Gly Cys Tyr
SEQ ID NO: 1077 Cys Cys hSer Phe Cys Cys Asn Thz Ala Cys Ala Gly Cys Tyr
SEQ ID NO: 1078 Cys Cys hSer Phe Cys Cys Asn HyPro Ala Cys Ala Gly Cys Tyr
SEQ ID NO: 1079 Cys Cys hSer Phe Cys Cys Asn Pip Ala Cys Ala Gly Cys Tyr
SEQ ID NO: 1080 Cys Cys hSer Phe Cys Cys Asn Ile Ala Cys Ala Gly Cys Tyr
SEQ ID NO: 1081 Cys Cys hSer Phe Cys Cys Asn Ala Ala Cys Ala Gly Cys Tyr
SEQ ID NO: 1082 Cys Cys hSer Tyr Cys Cys Asn Dhp Ala Cys Ala Gly Cys Tyr
SEQ ID NO: 1083 Cys Cys hSer Tyr Cys Cys Asn Thz Ala Cys Ala Gly Cys Tyr
SEQ ID NO: 1084 Cys Cys hSer Tyr Cys Cys Asn HyPro Ala Cys Ala Gly Cys Tyr
SEQ ID NO: 1085 Cys Cys hSer Tyr Cys Cys Asn Pip Ala Cys Ala Gly Cys Tyr
SEQ ID NO: 1086 Cys Cys hSer Tyr Cys Cys Asn Ile Ala Cys Ala Gly Cys Tyr
SEQ ID NO: 1087 Cys Cys hSer Tyr Cys Cys Asn Ala Ala Cys Ala Gly Cys Tyr
SEQ ID NO: 1088 Cys Cys hSer Dopa Cys Cys Asn Dhp Ala Cys Ala Gly Cys Tyr
SEQ ID NO: 1089 Cys Cys hSer Dopa Cys Cys Asn Thz Ala Cys Ala Gly Cys Tyr
SEQ ID NO: 1090 Cys Cys hSer Dopa Cys Cys Asn HyPro Ala Cys Ala Gly Cys Tyr
SEQ ID NO: 1091 Cys Cys hSer Dopa Cys Cys Asn Pip Ala Cys Ala Gly Cys Tyr
SEQ ID NO: 1092 Cys Cys hSer Dopa Cys Cys Asn Ile Ala Cys Ala Gly Cys Tyr
SEQ ID NO: 1093 Cys Cys hSer Dopa Cys Cys Asn Ala Ala Cys Ala Gly Cys Tyr
SEQ ID NO: 1094 Cys Cys hSer NMe-Leu Cys Cys Asn Dhp Ala Cys Ala Gly Cys Tyr
SEQ ID NO: 1095 Cys Cys hSer NMe-Leu Cys Cys Asn Thz Ala Cys Ala Gly Cys Tyr
SEQ ID NO: 1096 Cys Cys hSer NMe-Leu Cys Cys Asn HyPro Ala Cys Ala Gly Cys Tyr
SEQ ID NO: 1097 Cys Cys hSer NMe-Leu Cys Cys Asn Pip Ala Cys Ala Gly Cys Tyr
SEQ ID NO: 1098 Cys Cys hSer NMe-Leu Cys Cys Asn Ile Ala Cys Ala Gly Cys Tyr
SEQ ID NO: 1099 Cys Cys hSer NMe-Leu Cys Cys Asn Ala Ala Cys Ala Gly Cys Tyr
SEQ ID NO: 1100 Cys Cys hSer Thr Cys Cys Asn Pro Ala Cys Thr Gly Cys Tyr
SEQ ID NO: 1101 Cys Cys hSer Thr Cys Cys Asn Pro Ala Cys Ser Gly Cys Tyr
SEQ ID NO: 1102 Cys Cys hSer Thr Cys Cys Asn Pro Ala Cys 4F-Phe Gly Cys Tyr
SEQ ID NO: 1103 Cys Cys hSer Thr Cys Cys Asn Pro Ala Cys 4MeO-Phe Gly Cys Tyr
SEQ ID NO: 1104 Cys Cys hSer Thr Cys Cys Asn Pro Ala Cys 4NO2-Phe Gly Cys Tyr
SEQ ID NO: 1105 Cys Cys hSer Thr Cys Cys Asn Pro Ala Cys 5F-Phe Gly Cys Tyr
SEQ ID NO: 1106 Cys Cys hSer Thr Cys Cys Asn Pro Ala Cys 4MeF3-Phe Gly Cys Tyr
SEQ ID NO: 1107 Cys Cys hSer hLeu Cys Cys Asn Pro Ala Cys Thr Gly Cys Tyr
SEQ ID NO: 1108 Cys Cys hSer hLeu Cys Cys Asn Pro Ala Cys Ser Gly Cys Tyr
SEQ ID NO: 1109 Cys Cys hSer hLeu Cys Cys Asn Pro Ala Cys 4F-Phe Gly Cys Tyr
SEQ ID NO: 1110 Cys Cys hSer hLeu Cys Cys Asn Pro Ala Cys 4MeO-Phe Gly Cys Tyr
SEQ ID NO: 1111 Cys Cys hSer hLeu Cys Cys Asn Pro Ala Cys 4NO2-Phe Gly Cys Tyr
SEQ ID NO: 1112 Cys Cys hSer hLeu Cys Cys Asn Pro Ala Cys 5F-Phe Gly Cys Tyr
SEQ ID NO: 1113 Cys Cys hSer hLeu Cys Cys Asn Pro Ala Cys 4MeF3-Phe Gly Cys Tyr TABLE 3C-continued Triple substitutions from Scheme 1

| SEQ ID NO: | Sequence |
|---|---|
| 1114 | Cys Cys hSer norLeu Cys Cys Asn Pro Ala Cys Thr Gly Cys Tyr |
| 1115 | Cys Cys hSer norLeu Cys Cys Asn Pro Ala Cys Ser Gly Cys Tyr |
| 1116 | Cys Cys hSer norLeu Cys Cys Asn Pro Ala Cys 4F-Phe Gly Cys Tyr |
| 1117 | Cys Cys hSer norLeu Cys Cys Asn Pro Ala Cys 4MeO-Phe Gly Cys Tyr |
| 1118 | Cys Cys hSer norLeu Cys Cys Asn Pro Ala Cys 4NO2-Phe Gly Cys Tyr |
| 1119 | Cys Cys hSer norLeu Cys Cys Asn Pro Ala Cys 5F-Phe Gly Cys Tyr |
| 1120 | Cys Cys hSer norLeu Cys Cys Asn Pro Ala Cys 4MeF3-Phe Gly Cys Tyr |
| 1121 | Cys Cys hSer norLeu Cys Cys Asn Pro Ala Cys Thr Gly Cys Tyr |
| 1122 | Cys Cys hSer ChxAla Cys Cys Asn Pro Ala Cys Ser Gly Cys Tyr |
| 1123 | Cys Cys hSer ChxAla Cys Cys Asn Pro Ala Cys 4F-Phe Gly Cys Tyr |
| 1124 | Cys Cys hSer ChxAla Cys Cys Asn Pro Ala Cys 4MeO-Phe Gly Cys Tyr |
| 1125 | Cys Cys hSer ChxAla Cys Cys Asn Pro Ala Cys 4NO2-Phe Gly Cys Tyr |
| 1126 | Cys Cys hSer ChxAla Cys Cys Asn Pro Ala Cys 5F-Phe Gly Cys Tyr |
| 1127 | Cys Cys hSer ChxAla Cys Cys Asn Pro Ala Cys 4MeF3-Phe Gly Cys Tyr |
| 1128 | Cys Cys hSer ChxIle Cys Cys Asn Pro Ala Cys Thr Gly Cys Tyr |
| 1129 | Cys Cys hSer ChxIle Cys Cys Asn Pro Ala Cys Ser Gly Cys Tyr |
| 1130 | Cys Cys hSer ChxIle Cys Cys Asn Pro Ala Cys 4F-Phe Gly Cys Tyr |
| 1131 | Cys Cys hSer ChxIle Cys Cys Asn Pro Ala Cys 4MeO-Phe Gly Cys Tyr |
| 1132 | Cys Cys hSer ChxIle Cys Cys Asn Pro Ala Cys 4NO2-Phe Gly Cys Tyr |
| 1133 | Cys Cys hSer ChxIle Cys Cys Asn Pro Ala Cys 5F-Phe Gly Cys Tyr |
| 1134 | Cys Cys hSer ChxIle Cys Cys Asn Pro Ala Cys 4MeF3-Phe Gly Cys Tyr |
| 1135 | Cys Cys hSer Phe Cys Cys Asn Pro Ala Cys Thr Gly Cys Tyr |
| 1136 | Cys Cys hSer Phe Cys Cys Asn Pro Ala Cys Ser Gly Cys Tyr |
| 1137 | Cys Cys hSer Phe Cys Cys Asn Pro Ala Cys 4F-Phe Gly Cys Tyr |
| 1138 | Cys Cys hSer Phe Cys Cys Asn Pro Ala Cys 4MeO-Phe Gly Cys Tyr |
| 1139 | Cys Cys hSer Phe Cys Cys Asn Pro Ala Cys 4NO2-Phe Gly Cys Tyr |
| 1140 | Cys Cys hSer Phe Cys Cys Asn Pro Ala Cys 5F-Phe Gly Cys Tyr |
| 1141 | Cys Cys hSer Phe Cys Cys Asn Pro Ala Cys 4MeF3-Phe Gly Cys Tyr |
| 1142 | Cys Cys hSer Tyr Cys Cys Asn Pro Ala Cys Thr Gly Cys Tyr |
| 1143 | Cys Cys hSer Tyr Cys Cys Asn Pro Ala Cys Ser Gly Cys Tyr |
| 1144 | Cys Cys hSer Tyr Cys Cys Asn Pro Ala Cys 4F-Phe Gly Cys Tyr |
| 1145 | Cys Cys hSer Tyr Cys Cys Asn Pro Ala Cys 4MeO-Phe Gly Cys Tyr |
| 1146 | Cys Cys hSer Tyr Cys Cys Asn Pro Ala Cys 4NO2-Phe Gly Cys Tyr |
| 1147 | Cys Cys hSer Tyr Cys Cys Asn Pro Ala Cys 5F-Phe Gly Cys Tyr |
| 1148 | Cys Cys hSer Tyr Cys Cys Asn Pro Ala Cys 4MeF3-Phe Gly Cys Tyr |
| 1149 | Cys Cys hSer Dopa Cys Cys Asn Pro Ala Cys Thr Gly Cys Tyr |
| 1150 | Cys Cys hSer Dopa Cys Cys Asn Pro Ala Cys Ser Gly Cys Tyr |
| 1151 | Cys Cys hSer Dopa Cys Cys Asn Pro Ala Cys 4F-Phe Gly Cys Tyr |
| 1152 | Cys Cys hSer Dopa Cys Cys Asn Pro Ala Cys 4MeO-Phe Gly Cys Tyr |

TABLE 3C-continued

Triple substitutions from Scheme 1

| | | | | | | | | | | | | | |
|---|---|---|---|---|---|---|---|---|---|---|---|---|---|
| SEQ ID NO: 1153 | Cys | Cys | hSer | Dopa | Cys | Cys | Asn | Pro | Ala | Cys | 4NO2-Phe | Gly | Cys | Tyr |
| SEQ ID NO: 1154 | Cys | Cys | hSer | Dopa | Cys | Cys | Asn | Pro | Ala | Cys | 5F-Phe | Gly | Cys | Tyr |
| SEQ ID NO: 1155 | Cys | Cys | hSer | Dopa | Cys | Cys | Asn | Pro | Ala | Cys | 4MeF3-Phe | Gly | Cys | Tyr |
| SEQ ID NO: 1156 | Cys | Cys | hSer | NMe-Leu | Cys | Cys | Asn | Pro | Ala | Cys | Thr | Gly | Cys | Tyr |
| SEQ ID NO: 1157 | Cys | Cys | hSer | NMe-Leu | Cys | Cys | Asn | Pro | Ala | Cys | Ser | Gly | Cys | Tyr |
| SEQ ID NO: 1158 | Cys | Cys | hSer | NMe-Leu | Cys | Cys | Asn | Pro | Ala | Cys | 4F-Phe | Gly | Cys | Tyr |
| SEQ ID NO: 1159 | Cys | Cys | hSer | NMe-Leu | Cys | Cys | Asn | Pro | Ala | Cys | 4MeO-Phe | Gly | Cys | Tyr |
| SEQ ID NO: 1160 | Cys | Cys | hSer | NMe-Leu | Cys | Cys | Asn | Pro | Ala | Cys | 4NO2-Phe | Gly | Cys | Tyr |
| SEQ ID NO: 1161 | Cys | Cys | hSer | NMe-Leu | Cys | Cys | Asn | Pro | Ala | Cys | 5F-Phe | Gly | Cys | Tyr |
| SEQ ID NO: 1162 | Cys | Cys | hSer | NMe-Leu | Cys | Cys | Asn | Pro | Ala | Cys | 4MeF3-Phe | Gly | Cys | Tyr |
| SEQ ID NO: 1163 | Cys | Cys | hSer | Thr | Cys | Cys | Asn | Pro | Ala | Cys | Ala | D-Ala | Cys | Tyr |
| SEQ ID NO: 1164 | Cys | Cys | hSer | hLeu | Cys | Cys | Asn | Pro | Ala | Cys | Ala | D-Ala | Cys | Tyr |
| SEQ ID NO: 1165 | Cys | Cys | hSer | norLeu | Cys | Cys | Asn | Pro | Ala | Cys | Ala | D-Ala | Cys | Tyr |
| SEQ ID NO: 1166 | Cys | Cys | hSer | ChxAla | Cys | Cys | Asn | Pro | Ala | Cys | Ala | D-Ala | Cys | Tyr |
| SEQ ID NO: 1167 | Cys | Cys | hSer | ChxIle | Cys | Cys | Asn | Pro | Ala | Cys | Ala | D-Ala | Cys | Tyr |
| SEQ ID NO: 1168 | Cys | Cys | hSer | Phe | Cys | Cys | Asn | Pro | Ala | Cys | Ala | D-Ala | Cys | Tyr |
| SEQ ID NO: 1169 | Cys | Cys | hSer | Tyr | Cys | Cys | Asn | Pro | Ala | Cys | Ala | D-Ala | Cys | Tyr |
| SEQ ID NO: 1170 | Cys | Cys | hSer | Dopa | Cys | Cys | Asn | Pro | Ala | Cys | Ala | D-Ala | Cys | Tyr |
| SEQ ID NO: 1171 | Cys | Cys | hSer | NMe-Leu | Cys | Cys | Asn | Pro | Ala | Cys | Ala | D-Ala | Cys | Tyr |
| SEQ ID NO: 1172 | Cys | Cys | hSer | Thr | Cys | Cys | Asn | Pro | Ala | Cys | Ala | Gly | Cys | Ile |
| SEQ ID NO: 1173 | Cys | Cys | hSer | Thr | Cys | Cys | Asn | Pro | Ala | Cys | Ala | Gly | Cys | Trp |
| SEQ ID NO: 1174 | Cys | Cys | hSer | hLeu | Cys | Cys | Asn | Pro | Ala | Cys | Ala | Gly | Cys | Ile |
| SEQ ID NO: 1175 | Cys | Cys | hSer | hLeu | Cys | Cys | Asn | Pro | Ala | Cys | Ala | Gly | Cys | Trp |
| SEQ ID NO: 1176 | Cys | Cys | hSer | norLeu | Cys | Cys | Asn | Pro | Ala | Cys | Ala | Gly | Cys | Ile |
| SEQ ID NO: 1177 | Cys | Cys | hSer | norLeu | Cys | Cys | Asn | Pro | Ala | Cys | Ala | Gly | Cys | Trp |
| SEQ ID NO: 1178 | Cys | Cys | hSer | ChxAla | Cys | Cys | Asn | Pro | Ala | Cys | Ala | Gly | Cys | Ile |
| SEQ ID NO: 1179 | Cys | Cys | hSer | ChxAla | Cys | Cys | Asn | Pro | Ala | Cys | Ala | Gly | Cys | Trp |
| SEQ ID NO: 1180 | Cys | Cys | hSer | ChxIle | Cys | Cys | Asn | Pro | Ala | Cys | Ala | Gly | Cys | Ile |
| SEQ ID NO: 1181 | Cys | Cys | hSer | ChxIle | Cys | Cys | Asn | Pro | Ala | Cys | Ala | Gly | Cys | Trp |
| SEQ ID NO: 1182 | Cys | Cys | hSer | Phe | Cys | Cys | Asn | Pro | Ala | Cys | Ala | Gly | Cys | Ile |
| SEQ ID NO: 1183 | Cys | Cys | hSer | Phe | Cys | Cys | Asn | Pro | Ala | Cys | Ala | Gly | Cys | Trp |
| SEQ ID NO: 1184 | Cys | Cys | hSer | Tyr | Cys | Cys | Asn | Pro | Ala | Cys | Ala | Gly | Cys | Ile |
| SEQ ID NO: 1185 | Cys | Cys | hSer | Tyr | Cys | Cys | Asn | Pro | Ala | Cys | Ala | Gly | Cys | Trp |
| SEQ ID NO: 1186 | Cys | Cys | hSer | Dopa | Cys | Cys | Asn | Pro | Ala | Cys | Ala | Gly | Cys | Ile |
| SEQ ID NO: 1187 | Cys | Cys | hSer | Dopa | Cys | Cys | Asn | Pro | Ala | Cys | Ala | Gly | Cys | Trp |
| SEQ ID NO: 1188 | Cys | Cys | hSer | NMe-Leu | Cys | Cys | Asn | Pro | Ala | Cys | Ala | Gly | Cys | Ile |
| SEQ ID NO: 1189 | Cys | Cys | hSer | NMe-Leu | Cys | Cys | Asn | Pro | Ala | Cys | Ala | Gly | Cys | Trp |
| SEQ ID NO: 1190 | Cys | Cys | Csa | Thr | Cys | Cys | Asn | Dhp | Ala | Cys | Ala | Gly | Cys | Tyr |
| SEQ ID NO: 1191 | Cys | Cys | Csa | Thr | Cys | Cys | Asn | Thz | Ala | Cys | Ala | Gly | Cys | Tyr |

TABLE 3C-continued

Triple substitutions from Scheme 1

| SEQ ID NO: | Sequence |
|---|---|
| 1192 | Cys Cys Csa Thr Cys Cys Asn HyPro Ala Cys Ala Gly Cys Tyr |
| 1193 | Cys Cys Csa Thr Cys Cys Asn Pip Ala Cys Ala Gly Cys Tyr |
| 1194 | Cys Cys Csa Thr Cys Cys Asn Ile Ala Cys Ala Gly Cys Tyr |
| 1195 | Cys Cys Csa Thr Cys Cys Asn Ala Ala Cys Ala Gly Cys Tyr |
| 1196 | Cys Cys Csa hLeu Cys Cys Asn Dhp Ala Cys Ala Gly Cys Tyr |
| 1197 | Cys Cys Csa hLeu Cys Cys Asn Thz Ala Cys Ala Gly Cys Tyr |
| 1198 | Cys Cys Csa hLeu Cys Cys Asn HyPro Ala Cys Ala Gly Cys Tyr |
| 1199 | Cys Cys Csa hLeu Cys Cys Asn Pip Ala Cys Ala Gly Cys Tyr |
| 1200 | Cys Cys Csa hLeu Cys Cys Asn Ile Ala Cys Ala Gly Cys Tyr |
| 1201 | Cys Cys Csa hLeu Cys Cys Asn Ala Ala Cys Ala Gly Cys Tyr |
| 1202 | Cys Cys Csa norLeu Cys Cys Asn Dhp Ala Cys Ala Gly Cys Tyr |
| 1203 | Cys Cys Csa norLeu Cys Cys Asn Thz Ala Cys Ala Gly Cys Tyr |
| 1204 | Cys Cys Csa norLeu Cys Cys Asn HyPro Ala Cys Ala Gly Cys Tyr |
| 1205 | Cys Cys Csa norLeu Cys Cys Asn Pip Ala Cys Ala Gly Cys Tyr |
| 1206 | Cys Cys Csa norLeu Cys Cys Asn Ile Ala Cys Ala Gly Cys Tyr |
| 1207 | Cys Cys Csa norLeu Cys Cys Asn Ala Ala Cys Ala Gly Cys Tyr |
| 1208 | Cys Cys Csa ChxAla Cys Cys Asn Dhp Ala Cys Ala Gly Cys Tyr |
| 1209 | Cys Cys Csa ChxAla Cys Cys Asn Thz Ala Cys Ala Gly Cys Tyr |
| 1210 | Cys Cys Csa ChxAla Cys Cys Asn HyPro Ala Cys Ala Gly Cys Tyr |
| 1211 | Cys Cys Csa ChxAla Cys Cys Asn Pip Ala Cys Ala Gly Cys Tyr |
| 1212 | Cys Cys Csa ChxAla Cys Cys Asn Ile Ala Cys Ala Gly Cys Tyr |
| 1213 | Cys Cys Csa ChxAla Cys Cys Asn Ala Ala Cys Ala Gly Cys Tyr |
| 1214 | Cys Cys Csa ChxIle Cys Cys Asn Dhp Ala Cys Ala Gly Cys Tyr |
| 1215 | Cys Cys Csa ChxIle Cys Cys Asn Thz Ala Cys Ala Gly Cys Tyr |
| 1216 | Cys Cys Csa ChxIle Cys Cys Asn HyPro Ala Cys Ala Gly Cys Tyr |
| 1217 | Cys Cys Csa ChxIle Cys Cys Asn Pip Ala Cys Ala Gly Cys Tyr |
| 1218 | Cys Cys Csa ChxIle Cys Cys Asn Ile Ala Cys Ala Gly Cys Tyr |
| 1219 | Cys Cys Csa ChxIle Cys Cys Asn Ala Ala Cys Ala Gly Cys Tyr |
| 1220 | Cys Cys Csa Phe Cys Cys Asn Dhp Ala Cys Ala Gly Cys Tyr |
| 1221 | Cys Cys Csa Phe Cys Cys Asn Thz Ala Cys Ala Gly Cys Tyr |
| 1222 | Cys Cys Csa Phe Cys Cys Asn HyPro Ala Cys Ala Gly Cys Tyr |
| 1223 | Cys Cys Csa Phe Cys Cys Asn Pip Ala Cys Ala Gly Cys Tyr |
| 1224 | Cys Cys Csa Phe Cys Cys Asn Ile Ala Cys Ala Gly Cys Tyr |
| 1225 | Cys Cys Csa Phe Cys Cys Asn Ala Ala Cys Ala Gly Cys Tyr |
| 1226 | Cys Cys Csa Tyr Cys Cys Asn Dhp Ala Cys Ala Gly Cys Tyr |
| 1227 | Cys Cys Csa Tyr Cys Cys Asn Thz Ala Cys Ala Gly Cys Tyr |
| 1228 | Cys Cys Csa Tyr Cys Cys Asn HyPro Ala Cys Ala Gly Cys Tyr |
| 1229 | Cys Cys Csa Tyr Cys Cys Asn Pip Ala Cys Ala Gly Cys Tyr |
| 1230 | Cys Cys Csa Tyr Cys Cys Asn Ile Ala Cys Ala Gly Cys Tyr |

TABLE 3C-continued

Triple substitutions from Scheme 1

SEQ ID NO: 1231 Cys Cys Csa Tyr Cys Cys Asn Ala Ala Cys Ala Gly Cys Tyr
SEQ ID NO: 1232 Cys Cys Csa Dopa Cys Cys Asn Dhp Ala Cys Ala Gly Cys Tyr
SEQ ID NO: 1233 Cys Cys Csa Dopa Cys Cys Asn Thz Ala Cys Ala Gly Cys Tyr
SEQ ID NO: 1234 Cys Cys Csa Dopa Cys Cys Asn HyPro Ala Cys Ala Gly Cys Tyr
SEQ ID NO: 1235 Cys Cys Csa Dopa Cys Cys Asn Pip Ala Cys Ala Gly Cys Tyr
SEQ ID NO: 1236 Cys Cys Csa Dopa Cys Cys Asn Ile Ala Cys Ala Gly Cys Tyr
SEQ ID NO: 1237 Cys Cys Csa Dopa Cys Cys Asn Ala Ala Cys Ala Gly Cys Tyr
SEQ ID NO: 1238 Cys Cys Csa NMe-Leu Cys Cys Asn Dhp Ala Cys Ala Gly Cys Tyr
SEQ ID NO: 1239 Cys Cys Csa NMe-Leu Cys Cys Asn Thz Ala Cys Ala Gly Cys Tyr
SEQ ID NO: 1240 Cys Cys Csa NMe-Leu Cys Cys Asn HyPro Ala Cys Ala Gly Cys Tyr
SEQ ID NO: 1241 Cys Cys Csa NMe-Leu Cys Cys Asn Pip Ala Cys Ala Gly Cys Tyr
SEQ ID NO: 1242 Cys Cys Csa NMe-Leu Cys Cys Asn Ile Ala Cys Ala Gly Cys Tyr
SEQ ID NO: 1243 Cys Cys Csa NMe-Leu Cys Cys Asn Ala Ala Cys Ala Gly Cys Tyr
SEQ ID NO: 1244 Cys Cys Csa Thr Cys Cys Asn Pro Ala Cys Thr Gly Cys Tyr
SEQ ID NO: 1245 Cys Cys Csa Thr Cys Cys Asn Pro Ala Cys Ser Gly Cys Tyr
SEQ ID NO: 1246 Cys Cys Csa Thr Cys Cys Asn Pro Ala Cys 4F-Phe Gly Cys Tyr
SEQ ID NO: 1247 Cys Cys Csa Thr Cys Cys Asn Pro Ala Cys 4MeO-Phe Gly Cys Tyr
SEQ ID NO: 1248 Cys Cys Csa Thr Cys Cys Asn Pro Ala Cys 4NO2-Phe Gly Cys Tyr
SEQ ID NO: 1249 Cys Cys Csa Thr Cys Cys Asn Pro Ala Cys 5F-Phe Gly Cys Tyr
SEQ ID NO: 1250 Cys Cys Csa Thr Cys Cys Asn Pro Ala Cys 4MeF3-Phe Gly Cys Tyr
SEQ ID NO: 1251 Cys Cys Csa hLeu Cys Cys Asn Pro Ala Cys Thr Gly Cys Tyr
SEQ ID NO: 1252 Cys Cys Csa hLeu Cys Cys Asn Pro Ala Cys Ser Gly Cys Tyr
SEQ ID NO: 1253 Cys Cys Csa hLeu Cys Cys Asn Pro Ala Cys 4F-Phe Gly Cys Tyr
SEQ ID NO: 1254 Cys Cys Csa hLeu Cys Cys Asn Pro Ala Cys 4MeO-Phe Gly Cys Tyr
SEQ ID NO: 1255 Cys Cys Csa hLeu Cys Cys Asn Pro Ala Cys 4NO2-Phe Gly Cys Tyr
SEQ ID NO: 1256 Cys Cys Csa hLeu Cys Cys Asn Pro Ala Cys 5F-Phe Gly Cys Tyr
SEQ ID NO: 1257 Cys Cys Csa hLeu Cys Cys Asn Pro Ala Cys 4MeF3-Phe Gly Cys Tyr
SEQ ID NO: 1258 Cys Cys Csa norLeu Cys Cys Asn Pro Ala Cys Thr Gly Cys Tyr
SEQ ID NO: 1259 Cys Cys Csa norLeu Cys Cys Asn Pro Ala Cys Ser Gly Cys Tyr
SEQ ID NO: 1260 Cys Cys Csa norLeu Cys Cys Asn Pro Ala Cys 4F-Phe Gly Cys Tyr
SEQ ID NO: 1261 Cys Cys Csa norLeu Cys Cys Asn Pro Ala Cys 4MeO-Phe Gly Cys Tyr
SEQ ID NO: 1262 Cys Cys Csa norLeu Cys Cys Asn Pro Ala Cys 4NO2-Phe Gly Cys Tyr
SEQ ID NO: 1263 Cys Cys Csa norLeu Cys Cys Asn Pro Ala Cys 5F-Phe Gly Cys Tyr
SEQ ID NO: 1264 Cys Cys Csa norLeu Cys Cys Asn Pro Ala Cys 4MeF3-Phe Gly Cys Tyr
SEQ ID NO: 1265 Cys Cys Csa norLeu Cys Cys Asn Pro Ala Cys Thr Gly Cys Tyr
SEQ ID NO: 1266 Cys Cys Csa ChxAla Cys Cys Asn Pro Ala Cys Ser Gly Cys Tyr
SEQ ID NO: 1267 Cys Cys Csa ChxAla Cys Cys Asn Pro Ala Cys 4F-Phe Gly Cys Tyr
SEQ ID NO: 1268 Cys Cys Csa ChxAla Cys Cys Asn Pro Ala Cys 4MeO-Phe Gly Cys Tyr
SEQ ID NO: 1269 Cys Cys Csa ChxAla Cys Cys Asn Pro Ala Cys 4NO2-Phe Gly Cys Tyr TABLE 3C-continued Triple substitutions from Scheme 1

SEQ ID NO: 1270 Cys Cys Csa ChxAla Cys Cys Asn Pro Ala Cys 5F-Phe Gly Cys Tyr
SEQ ID NO: 1271 Cys Cys Csa ChxAla Cys Cys Asn Pro Ala Cys 4MeF3-Phe Gly Cys Tyr
SEQ ID NO: 1272 Cys Cys Csa ChxIle Cys Cys Asn Pro Ala Cys Thr Gly Cys Tyr
SEQ ID NO: 1273 Cys Cys Csa ChxIle Cys Cys Asn Pro Ala Cys Ser Gly Cys Tyr
SEQ ID NO: 1274 Cys Cys Csa ChxIle Cys Cys Asn Pro Ala Cys 4F-Phe Gly Cys Tyr
SEQ ID NO: 1275 Cys Cys Csa ChxIle Cys Cys Asn Pro Ala Cys 4MeO-Phe Gly Cys Tyr
SEQ ID NO: 1276 Cys Cys Csa ChxIle Cys Cys Asn Pro Ala Cys 4NO2-Phe Gly Cys Tyr
SEQ ID NO: 1277 Cys Cys Csa ChxIle Cys Cys Asn Pro Ala Cys 5F-Phe Gly Cys Tyr
SEQ ID NO: 1278 Cys Cys Csa ChxIle Cys Cys Asn Pro Ala Cys 4MeF3-Phe Gly Cys Tyr
SEQ ID NO: 1279 Cys Cys Csa Phe Cys Cys Asn Pro Ala Cys Thr Gly Cys Tyr
SEQ ID NO: 1280 Cys Cys Csa Phe Cys Cys Asn Pro Ala Cys Ser Gly Cys Tyr
SEQ ID NO: 1281 Cys Cys Csa Phe Cys Cys Asn Pro Ala Cys 4F-Phe Gly Cys Tyr
SEQ ID NO: 1282 Cys Cys Csa Phe Cys Cys Asn Pro Ala Cys 4MeO-Phe Gly Cys Tyr
SEQ ID NO: 1283 Cys Cys Csa Phe Cys Cys Asn Pro Ala Cys 4NO2-Phe Gly Cys Tyr
SEQ ID NO: 1284 Cys Cys Csa Phe Cys Cys Asn Pro Ala Cys 5F-Phe Gly Cys Tyr
SEQ ID NO: 1285 Cys Cys Csa Phe Cys Cys Asn Pro Ala Cys 4MeF3-Phe Gly Cys Tyr
SEQ ID NO: 1286 Cys Cys Csa Tyr Cys Cys Asn Pro Ala Cys Thr Gly Cys Tyr
SEQ ID NO: 1287 Cys Cys Csa Tyr Cys Cys Asn Pro Ala Cys Ser Gly Cys Tyr
SEQ ID NO: 1288 Cys Cys Csa Tyr Cys Cys Asn Pro Ala Cys 4F-Phe Gly Cys Tyr
SEQ ID NO: 1289 Cys Cys Csa Tyr Cys Cys Asn Pro Ala Cys 4MeO-Phe Gly Cys Tyr
SEQ ID NO: 1290 Cys Cys Csa Tyr Cys Cys Asn Pro Ala Cys 4NO2-Phe Gly Cys Tyr
SEQ ID NO: 1291 Cys Cys Csa Tyr Cys Cys Asn Pro Ala Cys 5F-Phe Gly Cys Tyr
SEQ ID NO: 1292 Cys Cys Csa Tyr Cys Cys Asn Pro Ala Cys 4MeF3-Phe Gly Cys Tyr
SEQ ID NO: 1293 Cys Cys Csa Dopa Cys Cys Asn Pro Ala Cys Thr Gly Cys Tyr
SEQ ID NO: 1294 Cys Cys Csa Dopa Cys Cys Asn Pro Ala Cys Ser Gly Cys Tyr
SEQ ID NO: 1295 Cys Cys Csa Dopa Cys Cys Asn Pro Ala Cys 4F-Phe Gly Cys Tyr
SEQ ID NO: 1296 Cys Cys Csa Dopa Cys Cys Asn Pro Ala Cys 4MeO-Phe Gly Cys Tyr
SEQ ID NO: 1297 Cys Cys Csa Dopa Cys Cys Asn Pro Ala Cys 4NO2-Phe Gly Cys Tyr
SEQ ID NO: 1298 Cys Cys Csa Dopa Cys Cys Asn Pro Ala Cys 5F-Phe Gly Cys Tyr
SEQ ID NO: 1299 Cys Cys Csa Dopa Cys Cys Asn Pro Ala Cys 4MeF3-Phe Gly Cys Tyr
SEQ ID NO: 1300 Cys Cys Csa NMe-Leu Cys Cys Asn Pro Ala Cys Thr Gly Cys Tyr
SEQ ID NO: 1301 Cys Cys Csa NMe-Leu Cys Cys Asn Pro Ala Cys Ser Gly Cys Tyr
SEQ ID NO: 1302 Cys Cys Csa NMe-Leu Cys Cys Asn Pro Ala Cys 4F-Phe Gly Cys Tyr
SEQ ID NO: 1303 Cys Cys Csa NMe-Leu Cys Cys Asn Pro Ala Cys 4MeO-Phe Gly Cys Tyr
SEQ ID NO: 1304 Cys Cys Csa NMe-Leu Cys Cys Asn Pro Ala Cys 4NO2-Phe Gly Cys Tyr
SEQ ID NO: 1305 Cys Cys Csa NMe-Leu Cys Cys Asn Pro Ala Cys 5F-Phe Gly Cys Tyr
SEQ ID NO: 1306 Cys Cys Csa NMe-Leu Cys Cys Asn Pro Ala Cys 4MeF3-Phe Gly Cys Tyr
SEQ ID NO: 1307 Cys Cys Csa Thr Cys Cys Asn Pro Ala Cys Ala D-Ala Cys Tyr
SEQ ID NO: 1308 Cys Cys Csa hLeu Cys Cys Asn Pro Ala Cys Ala D-Ala Cys Tyr TABLE 3C-continued Triple substitutions from Scheme 1

SEQ ID NO: 1309  Cys Cys Csa norLeu Cys Cys Asn Pro Ala Cys Ala D-Ala Cys Tyr

SEQ ID NO: 1310  Cys Cys Csa ChxAla Cys Cys Asn Pro Ala Cys Ala D-Ala Cys Tyr

SEQ ID NO: 1311  Cys Cys Csa ChxIle Cys Cys Asn Pro Ala Cys Ala D-Ala Cys Tyr

SEQ ID NO: 1312  Cys Cys Csa Phe Cys Cys Asn Pro Ala Cys Ala D-Ala Cys Tyr

SEQ ID NO: 1313  Cys Cys Csa Tyr Cys Cys Asn Pro Ala Cys Ala D-Ala Cys Tyr

SEQ ID NO: 1314  Cys Cys Csa Dopa Cys Cys Asn Pro Ala Cys Ala D-Ala Cys Tyr

SEQ ID NO: 1315  Cys Cys Csa NMe-Leu Cys Cys Asn Pro Ala Cys Ala D-Ala Cys Tyr

SEQ ID NO: 1316  Cys Cys Csa Thr Cys Cys Asn Pro Ala Cys Ala Gly Cys Ile

SEQ ID NO: 1317  Cys Cys Csa Thr Cys Cys Asn Pro Ala Cys Ala Gly Cys Trp

SEQ ID NO: 1318  Cys Cys Csa hLeu Cys Cys Asn Pro Ala Cys Ala Gly Cys Ile

SEQ ID NO: 1319  Cys Cys Csa hLeu Cys Cys Asn Pro Ala Cys Ala Gly Cys Trp

SEQ ID NO: 1320  Cys Cys Csa norLeu Cys Cys Asn Pro Ala Cys Ala Gly Cys Ile

SEQ ID NO: 1321  Cys Cys Csa norLeu Cys Cys Asn Pro Ala Cys Ala Gly Cys Trp

SEQ ID NO: 1322  Cys Cys Csa ChxAla Cys Cys Asn Pro Ala Cys Ala Gly Cys Ile

SEQ ID NO: 1323  Cys Cys Csa ChxAla Cys Cys Asn Pro Ala Cys Ala Gly Cys Trp

SEQ ID NO: 1324  Cys Cys Csa ChxIle Cys Cys Asn Pro Ala Cys Ala Gly Cys Ile

SEQ ID NO: 1325  Cys Cys Csa ChxIle Cys Cys Asn Pro Ala Cys Ala Gly Cys Trp

SEQ ID NO: 1326  Cys Cys Csa Phe Cys Cys Asn Pro Ala Cys Ala Gly Cys Ile

SEQ ID NO: 1327  Cys Cys Csa Phe Cys Cys Asn Pro Ala Cys Ala Gly Cys Trp

SEQ ID NO: 1328  Cys Cys Csa Tyr Cys Cys Asn Pro Ala Cys Ala Gly Cys Ile

SEQ ID NO: 1329  Cys Cys Csa Tyr Cys Cys Asn Pro Ala Cys Ala Gly Cys Trp

SEQ ID NO: 1330  Cys Cys Csa Dopa Cys Cys Asn Pro Ala Cys Ala Gly Cys Ile

SEQ ID NO: 1331  Cys Cys Csa Dopa Cys Cys Asn Pro Ala Cys Ala Gly Cys Trp

SEQ ID NO: 1332  Cys Cys Csa NMe-Leu Cys Cys Asn Pro Ala Cys Ala Gly Cys Ile

SEQ ID NO: 1333  Cys Cys Csa NMe-Leu Cys Cys Asn Pro Ala Cys Ala Gly Cys Trp

SEQ ID NO: 1334  Cys Cys Ser Leu Cys Cys Asn Dhp Ala Cys Thr Gly Cys Tyr

SEQ ID NO: 1335  Cys Cys Ser Leu Cys Cys Asn Dhp Ala Cys Ser Gly Cys Tyr

SEQ ID NO: 1336  Cys Cys Ser Leu Cys Cys Asn Dhp Ala Cys 4F-Phe Gly Cys Tyr

SEQ ID NO: 1337  Cys Cys Ser Leu Cys Cys Asn Dhp Ala Cys 4MeO-Phe Gly Cys Tyr

SEQ ID NO: 1338  Cys Cys Ser Leu Cys Cys Asn Dhp Ala Cys 4NO2-Phe Gly Cys Tyr

SEQ ID NO: 1339  Cys Cys Ser Leu Cys Cys Asn Dhp Ala Cys 5F-Phe Gly Cys Tyr

SEQ ID NO: 1340  Cys Cys Ser Leu Cys Cys Asn Dhp Ala Cys 4MeF3-Phe Gly Cys Tyr

SEQ ID NO: 1341  Cys Cys Ser Leu Cys Cys Asn Thz Ala Cys Thr Gly Cys Tyr

SEQ ID NO: 1342  Cys Cys Ser Leu Cys Cys Asn Thz Ala Cys Ser Gly Cys Tyr

SEQ ID NO: 1343  Cys Cys Ser Leu Cys Cys Asn Thz Ala Cys 4F-Phe Gly Cys Tyr

SEQ ID NO: 1344  Cys Cys Ser Leu Cys Cys Asn Thz Ala Cys 4MeO-Phe Gly Cys Tyr

SEQ ID NO: 1345  Cys Cys Ser Leu Cys Cys Asn Thz Ala Cys 4NO2-Phe Gly Cys Tyr

SEQ ID NO: 1346  Cys Cys Ser Leu Cys Cys Asn Thz Ala Cys 5F-Phe Gly Cys Tyr

SEQ ID NO: 1347  Cys Cys Ser Leu Cys Cys Asn Thz Ala Cys 4MeF3-Phe Gly Cys Tyr

TABLE 3C-continued

Triple substitutions from Scheme 1

| SEQ ID NO: 1348 | Cys Cys Ser Leu Cys Cys Asn HyPro Ala Cys Thr Gly Cys Tyr |
| SEQ ID NO: 1349 | Cys Cys Ser Leu Cys Cys Asn HyPro Ala Cys Ser Gly Cys Tyr |
| SEQ ID NO: 1350 | Cys Cys Ser Leu Cys Cys Asn HyPro Ala Cys 4F-Phe Gly Cys Tyr |
| SEQ ID NO: 1351 | Cys Cys Ser Leu Cys Cys Asn HyPro Ala Cys 4MeO-Phe Gly Cys Tyr |
| SEQ ID NO: 1352 | Cys Cys Ser Leu Cys Cys Asn HyPro Ala Cys 4NO2-Phe Gly Cys Tyr |
| SEQ ID NO: 1353 | Cys Cys Ser Leu Cys Cys Asn HyPro Ala Cys 5F-Phe Gly Cys Tyr |
| SEQ ID NO: 1354 | Cys Cys Ser Leu Cys Cys Asn HyPro Ala Cys 4MeF3-Phe Gly Cys Tyr |
| SEQ ID NO: 1355 | Cys Cys Ser Leu Cys Cys Asn Pip Ala Cys Thr Gly Cys Tyr |
| SEQ ID NO: 1356 | Cys Cys Ser Leu Cys Cys Asn Pip Ala Cys Ser Gly Cys Tyr |
| SEQ ID NO: 1357 | Cys Cys Ser Leu Cys Cys Asn Pip Ala Cys 4F-Phe Gly Cys Tyr |
| SEQ ID NO: 1358 | Cys Cys Ser Leu Cys Cys Asn Pip Ala Cys 4MeO-Phe Gly Cys Tyr |
| SEQ ID NO: 1359 | Cys Cys Ser Leu Cys Cys Asn Pip Ala Cys 4NO2-Phe Gly Cys Tyr |
| SEQ ID NO: 1360 | Cys Cys Ser Leu Cys Cys Asn Pip Ala Cys 5F-Phe Gly Cys Tyr |
| SEQ ID NO: 1361 | Cys Cys Ser Leu Cys Cys Asn Pip Ala Cys 4MeF3-Phe Gly Cys Tyr |
| SEQ ID NO: 1362 | Cys Cys Ser Leu Cys Cys Asn Ile Ala Cys Thr Gly Cys Tyr |
| SEQ ID NO: 1363 | Cys Cys Ser Leu Cys Cys Asn Ile Ala Cys Ser Gly Cys Tyr |
| SEQ ID NO: 1364 | Cys Cys Ser Leu Cys Cys Asn Ile Ala Cys 4F-Phe Gly Cys Tyr |
| SEQ ID NO: 1365 | Cys Cys Ser Leu Cys Cys Asn Ile Ala Cys 4MeO-Phe Gly Cys Tyr |
| SEQ ID NO: 1366 | Cys Cys Ser Leu Cys Cys Asn Ile Ala Cys 4NO2-Phe Gly Cys Tyr |
| SEQ ID NO: 1367 | Cys Cys Ser Leu Cys Cys Asn Ile Ala Cys 5F-Phe Gly Cys Tyr |
| SEQ ID NO: 1368 | Cys Cys Ser Leu Cys Cys Asn Ile Ala Cys 4MeF3-Phe Gly Cys Tyr |
| SEQ ID NO: 1369 | Cys Cys Ser Leu Cys Cys Asn Ala Ala Cys Thr Gly Cys Tyr |
| SEQ ID NO: 1370 | Cys Cys Ser Leu Cys Cys Asn Ala Ala Cys Ser Gly Cys Tyr |
| SEQ ID NO: 1371 | Cys Cys Ser Leu Cys Cys Asn Ala Ala Cys 4F-Phe Gly Cys Tyr |
| SEQ ID NO: 1372 | Cys Cys Ser Leu Cys Cys Asn Ala Ala Cys 4MeO-Phe Gly Cys Tyr |
| SEQ ID NO: 1373 | Cys Cys Ser Leu Cys Cys Asn Ala Ala Cys 4NO2-Phe Gly Cys Tyr |
| SEQ ID NO: 1374 | Cys Cys Ser Leu Cys Cys Asn Ala Ala Cys 5F-Phe Gly Cys Tyr |
| SEQ ID NO: 1375 | Cys Cys Ser Leu Cys Cys Asn Ala Ala Cys 4MeF3-Phe Gly Cys Tyr |
| SEQ ID NO: 1376 | Cys Cys Ser Leu Cys Cys Asn Dhp Ala Cys Ala D-Ala Cys Tyr |
| SEQ ID NO: 1377 | Cys Cys Ser Leu Cys Cys Asn Thz Ala Cys Ala D-Ala Cys Tyr |
| SEQ ID NO: 1378 | Cys Cys Ser Leu Cys Cys Asn HyPro Ala Cys Ala D-Ala Cys Tyr |
| SEQ ID NO: 1379 | Cys Cys Ser Leu Cys Cys Asn Pip Ala Cys Ala D-Ala Cys Tyr |
| SEQ ID NO: 1380 | Cys Cys Ser Leu Cys Cys Asn Ile Ala Cys Ala D-Ala Cys Tyr |
| SEQ ID NO: 1381 | Cys Cys Ser Leu Cys Cys Asn Ala Ala Cys Ala D-Ala Cys Tyr |
| SEQ ID NO: 1382 | Cys Cys Ser Leu Cys Cys Asn Dhp Ala Cys Ala Gly Cys Ile |
| SEQ ID NO: 1383 | Cys Cys Ser Leu Cys Cys Asn Thz Ala Cys Ala Gly Cys Ile |
| SEQ ID NO: 1384 | Cys Cys Ser Leu Cys Cys Asn HyPro Ala Cys Ala Gly Cys Ile |
| SEQ ID NO: 1385 | Cys Cys Ser Leu Cys Cys Asn Pip Ala Cys Ala Gly Cys Ile |
| SEQ ID NO: 1386 | Cys Cys Ser Leu Cys Cys Asn Ile Ala Cys Ala Gly Cys Ile |

TABLE 3C-continued

Triple substitutions from Scheme 1

| SEQ ID NO: 1387 | Cys Cys Ser Leu Cys Cys Asn Ala Ala Cys Ala Gly Cys Ile |
| SEQ ID NO: 1388 | Cys Cys Ser Leu Cys Cys Asn Dhp Ala Cys Ala Gly Cys Trp |
| SEQ ID NO: 1389 | Cys Cys Ser Leu Cys Cys Asn Thz Ala Cys Ala Gly Cys Trp |
| SEQ ID NO: 1390 | Cys Cys Ser Leu Cys Cys Asn HyPro Ala Cys Ala Gly Cys Trp |
| SEQ ID NO: 1391 | Cys Cys Ser Leu Cys Cys Asn Pip Ala Cys Ala Gly Cys Trp |
| SEQ ID NO: 1392 | Cys Cys Ser Leu Cys Cys Asn Ile Ala Cys Ala Gly Cys Trp |
| SEQ ID NO: 1393 | Cys Cys Ser Leu Cys Cys Asn Ala Ala Cys Ala Gly Cys Trp |
| SEQ ID NO: 1394 | Cys Cys hSer Leu Cys Cys Asn Dhp Ala Cys Thr Gly Cys Tyr |
| SEQ ID NO: 1395 | Cys Cys hSer Leu Cys Cys Asn Dhp Ala Cys Ser Gly Cys Tyr |
| SEQ ID NO: 1396 | Cys Cys hSer Leu Cys Cys Asn Dhp Ala Cys 4F-Phe Gly Cys Tyr |
| SEQ ID NO: 1397 | Cys Cys hSer Leu Cys Cys Asn Dhp Ala Cys 4MeO-Phe Gly Cys Tyr |
| SEQ ID NO: 1398 | Cys Cys hSer Leu Cys Cys Asn Dhp Ala Cys 4NO2-Phe Gly Cys Tyr |
| SEQ ID NO: 1399 | Cys Cys hSer Leu Cys Cys Asn Dhp Ala Cys 5F-Phe Gly Cys Tyr |
| SEQ ID NO: 1400 | Cys Cys hSer Leu Cys Cys Asn Dhp Ala Cys 4MeF3-Phe Gly Cys Tyr |
| SEQ ID NO: 1401 | Cys Cys hSer Leu Cys Cys Asn Thz Ala Cys Thr Gly Cys Tyr |
| SEQ ID NO: 1402 | Cys Cys hSer Leu Cys Cys Asn Thz Ala Cys Ser Gly Cys Tyr |
| SEQ ID NO: 1403 | Cys Cys hSer Leu Cys Cys Asn Thz Ala Cys 4F-Phe Gly Cys Tyr |
| SEQ ID NO: 1404 | Cys Cys hSer Leu Cys Cys Asn Thz Ala Cys 4MeO-Phe Gly Cys Tyr |
| SEQ ID NO: 1405 | Cys Cys hSer Leu Cys Cys Asn Thz Ala Cys 4NO2-Phe Gly Cys Tyr |
| SEQ ID NO: 1406 | Cys Cys hSer Leu Cys Cys Asn Thz Ala Cys 5F-Phe Gly Cys Tyr |
| SEQ ID NO: 1407 | Cys Cys hSer Leu Cys Cys Asn Thz Ala Cys 4MeF3-Phe Gly Cys Tyr |
| SEQ ID NO: 1408 | Cys Cys hSer Leu Cys Cys Asn HyPro Ala Cys Thr Gly Cys Tyr |
| SEQ ID NO: 1409 | Cys Cys hSer Leu Cys Cys Asn HyPro Ala Cys Ser Gly Cys Tyr |
| SEQ ID NO: 1410 | Cys Cys hSer Leu Cys Cys Asn HyPro Ala Cys 4F-Phe Gly Cys Tyr |
| SEQ ID NO: 1411 | Cys Cys hSer Leu Cys Cys Asn HyPro Ala Cys 4MeO-Phe Gly Cys Tyr |
| SEQ ID NO: 1412 | Cys Cys hSer Leu Cys Cys Asn HyPro Ala Cys 4NO2-Phe Gly Cys Tyr |
| SEQ ID NO: 1413 | Cys Cys hSer Leu Cys Cys Asn HyPro Ala Cys 5F-Phe Gly Cys Tyr |
| SEQ ID NO: 1414 | Cys Cys hSer Leu Cys Cys Asn HyPro Ala Cys 4MeF3-Phe Gly Cys Tyr |
| SEQ ID NO: 1415 | Cys Cys hSer Leu Cys Cys Asn Pip Ala Cys Thr Gly Cys Tyr |
| SEQ ID NO: 1416 | Cys Cys hSer Leu Cys Cys Asn Pip Ala Cys Ser Gly Cys Tyr |
| SEQ ID NO: 1417 | Cys Cys hSer Leu Cys Cys Asn Pip Ala Cys 4F-Phe Gly Cys Tyr |
| SEQ ID NO: 1418 | Cys Cys hSer Leu Cys Cys Asn Pip Ala Cys 4MeO-Phe Gly Cys Tyr |
| SEQ ID NO: 1419 | Cys Cys hSer Leu Cys Cys Asn Pip Ala Cys 4NO2-Phe Gly Cys Tyr |
| SEQ ID NO: 1420 | Cys Cys hSer Leu Cys Cys Asn Pip Ala Cys 5F-Phe Gly Cys Tyr |
| SEQ ID NO: 1421 | Cys Cys hSer Leu Cys Cys Asn Pip Ala Cys 4MeF3-Phe Gly Cys Tyr |
| SEQ ID NO: 1422 | Cys Cys hSer Leu Cys Cys Asn Ile Ala Cys Thr Gly Cys Tyr |
| SEQ ID NO: 1423 | Cys Cys hSer Leu Cys Cys Asn Ile Ala Cys Ser Gly Cys Tyr |
| SEQ ID NO: 1424 | Cys Cys hSer Leu Cys Cys Asn Ile Ala Cys 4F-Phe Gly Cys Tyr |
| SEQ ID NO: 1425 | Cys Cys hSer Leu Cys Cys Asn Ile Ala Cys 4MeO-Phe Gly Cys Tyr |

TABLE 3C-continued

Triple substitutions from Scheme 1

SEQ ID NO: 1426  Cys Cys hSer Leu Cys Cys Asn Ile Ala Cys 4NO2-Phe Gly Cys Tyr
SEQ ID NO: 1427  Cys Cys hSer Leu Cys Cys Asn Ile Ala Cys 5F-Phe Gly Cys Tyr
SEQ ID NO: 1428  Cys Cys hSer Leu Cys Cys Asn Ile Ala Cys 4MeF3-Phe Gly Cys Tyr
SEQ ID NO: 1429  Cys Cys hSer Leu Cys Cys Asn Ala Ala Cys Thr Gly Cys Tyr
SEQ ID NO: 1430  Cys Cys hSer Leu Cys Cys Asn Ala Ala Cys Ser Gly Cys Tyr
SEQ ID NO: 1431  Cys Cys hSer Leu Cys Cys Asn Ala Ala Cys 4F-Phe Gly Cys Tyr
SEQ ID NO: 1432  Cys Cys hSer Leu Cys Cys Asn Ala Ala Cys 4MeO-Phe Gly Cys Tyr
SEQ ID NO: 1433  Cys Cys hSer Leu Cys Cys Asn Ala Ala Cys 4NO2-Phe Gly Cys Tyr
SEQ ID NO: 1434  Cys Cys hSer Leu Cys Cys Asn Ala Ala Cys 5F-Phe Gly Cys Tyr
SEQ ID NO: 1435  Cys Cys hSer Leu Cys Cys Asn Ala Ala Cys 4MeF3-Phe Gly Cys Tyr
SEQ ID NO: 1436  Cys Cys hSer Leu Cys Cys Asn Dhp Ala Cys Ala D-Ala Cys Tyr
SEQ ID NO: 1437  Cys Cys hSer Leu Cys Cys Asn Thz Ala Cys Ala D-Ala Cys Tyr
SEQ ID NO: 1438  Cys Cys hSer Leu Cys Cys Asn HyPro Ala Cys Ala D-Ala Cys Tyr
SEQ ID NO: 1439  Cys Cys hSer Leu Cys Cys Asn Pip Ala Cys Ala D-Ala Cys Tyr
SEQ ID NO: 1440  Cys Cys hSer Leu Cys Cys Asn Ile Ala Cys Ala D-Ala Cys Tyr
SEQ ID NO: 1441  Cys Cys hSer Leu Cys Cys Asn Ala Ala Cys Ala D-Ala Cys Tyr
SEQ ID NO: 1442  Cys Cys hSer Leu Cys Cys Asn Dhp Ala Cys Ala Gly Cys Ile
SEQ ID NO: 1443  Cys Cys hSer Leu Cys Cys Asn Thz Ala Cys Ala Gly Cys Ile
SEQ ID NO: 1444  Cys Cys hSer Leu Cys Cys Asn HyPro Ala Cys Ala Gly Cys Ile
SEQ ID NO: 1445  Cys Cys hSer Leu Cys Cys Asn Pip Ala Cys Ala Gly Cys Ile
SEQ ID NO: 1446  Cys Cys hSer Leu Cys Cys Asn Ile Ala Cys Ala Gly Cys Ile
SEQ ID NO: 1447  Cys Cys hSer Leu Cys Cys Asn Ala Ala Cys Ala Gly Cys Ile
SEQ ID NO: 1448  Cys Cys hSer Leu Cys Cys Asn Dhp Ala Cys Ala Gly Cys Trp
SEQ ID NO: 1449  Cys Cys hSer Leu Cys Cys Asn Thz Ala Cys Ala Gly Cys Trp
SEQ ID NO: 1450  Cys Cys hSer Leu Cys Cys Asn HyPro Ala Cys Ala Gly Cys Trp
SEQ ID NO: 1451  Cys Cys hSer Leu Cys Cys Asn Pip Ala Cys Ala Gly Cys Trp
SEQ ID NO: 1452  Cys Cys hSer Leu Cys Cys Asn Ile Ala Cys Ala Gly Cys Trp
SEQ ID NO: 1453  Cys Cys hSer Leu Cys Cys Asn Ala Ala Cys Ala Gly Cys Trp
SEQ ID NO: 1454  Cys Cys Csa Leu Cys Cys Asn Dhp Ala Cys Thr Gly Cys Tyr
SEQ ID NO: 1455  Cys Cys Csa Leu Cys Cys Asn Dhp Ala Cys Ser Gly Cys Tyr
SEQ ID NO: 1456  Cys Cys Csa Leu Cys Cys Asn Dhp Ala Cys 4F-Phe Gly Cys Tyr
SEQ ID NO: 1457  Cys Cys Csa Leu Cys Cys Asn Dhp Ala Cys 4MeO-Phe Gly Cys Tyr
SEQ ID NO: 1458  Cys Cys Csa Leu Cys Cys Asn Dhp Ala Cys 4NO2-Phe Gly Cys Tyr
SEQ ID NO: 1459  Cys Cys Csa Leu Cys Cys Asn Dhp Ala Cys 5F-Phe Gly Cys Tyr
SEQ ID NO: 1460  Cys Cys Csa Leu Cys Cys Asn Dhp Ala Cys 4MeF3-Phe Gly Cys Tyr
SEQ ID NO: 1461  Cys Cys Csa Leu Cys Cys Asn Thz Ala Cys Thr Gly Cys Tyr
SEQ ID NO: 1462  Cys Cys Csa Leu Cys Cys Asn Thz Ala Cys Ser Gly Cys Tyr
SEQ ID NO: 1463  Cys Cys Csa Leu Cys Cys Asn Thz Ala Cys 4F-Phe Gly Cys Tyr
SEQ ID NO: 1464  Cys Cys Csa Leu Cys Cys Asn Thz Ala Cys 4MeO-Phe Gly Cys Tyr

TABLE 3C-continued

Triple substitutions from Scheme 1

SEQ ID NO: 1465  Cys Cys Csa Leu Cys Cys Asn Thz Ala Cys 4NO2-Phe Gly Cys Tyr
SEQ ID NO: 1466  Cys Cys Csa Leu Cys Cys Asn Thz Ala Cys 5F-Phe Gly Cys Tyr
SEQ ID NO: 1467  Cys Cys Csa Leu Cys Cys Asn Thz Ala Cys 4MeF3-Phe Gly Cys Tyr
SEQ ID NO: 1468  Cys Cys Csa Leu Cys Cys Asn HyPro Ala Cys Thr Gly Cys Tyr
SEQ ID NO: 1469  Cys Cys Csa Leu Cys Cys Asn HyPro Ala Cys Ser Gly Cys Tyr
SEQ ID NO: 1470  Cys Cys Csa Leu Cys Cys Asn HyPro Ala Cys 4F-Phe Gly Cys Tyr
SEQ ID NO: 1471  Cys Cys Csa Leu Cys Cys Asn HyPro Ala Cys 4MeO-Phe Gly Cys Tyr
SEQ ID NO: 1472  Cys Cys Csa Leu Cys Cys Asn HyPro Ala Cys 4NO2-Phe Gly Cys Tyr
SEQ ID NO: 1473  Cys Cys Csa Leu Cys Cys Asn HyPro Ala Cys 5F-Phe Gly Cys Tyr
SEQ ID NO: 1474  Cys Cys Csa Leu Cys Cys Asn HyPro Ala Cys 4MeF3-Phe Gly Cys Tyr
SEQ ID NO: 1475  Cys Cys Csa Leu Cys Cys Asn Pip Ala Cys Thr Gly Cys Tyr
SEQ ID NO: 1476  Cys Cys Csa Leu Cys Cys Asn Pip Ala Cys Ser Gly Cys Tyr
SEQ ID NO: 1477  Cys Cys Csa Leu Cys Cys Asn Pip Ala Cys 4F-Phe Gly Cys Tyr
SEQ ID NO: 1478  Cys Cys Csa Leu Cys Cys Asn Pip Ala Cys 4MeO-Phe Gly Cys Tyr
SEQ ID NO: 1479  Cys Cys Csa Leu Cys Cys Asn Pip Ala Cys 4NO2-Phe Gly Cys Tyr
SEQ ID NO: 1480  Cys Cys Csa Leu Cys Cys Asn Pip Ala Cys 5F-Phe Gly Cys Tyr
SEQ ID NO: 1481  Cys Cys Csa Leu Cys Cys Asn Pip Ala Cys 4MeF3-Phe Gly Cys Tyr
SEQ ID NO: 1482  Cys Cys Csa Leu Cys Cys Asn Ile Ala Cys Thr Gly Cys Tyr
SEQ ID NO: 1483  Cys Cys Csa Leu Cys Cys Asn Ile Ala Cys Ser Gly Cys Tyr
SEQ ID NO: 1484  Cys Cys Csa Leu Cys Cys Asn Ile Ala Cys 4F-Phe Gly Cys Tyr
SEQ ID NO: 1485  Cys Cys Csa Leu Cys Cys Asn Ile Ala Cys 4MeO-Phe Gly Cys Tyr
SEQ ID NO: 1486  Cys Cys Csa Leu Cys Cys Asn Ile Ala Cys 4NO2-Phe Gly Cys Tyr
SEQ ID NO: 1487  Cys Cys Csa Leu Cys Cys Asn Ile Ala Cys 5F-Phe Gly Cys Tyr
SEQ ID NO: 1488  Cys Cys Csa Leu Cys Cys Asn Ile Ala Cys 4MeF3-Phe Gly Cys Tyr
SEQ ID NO: 1489  Cys Cys Csa Leu Cys Cys Asn Ala Ala Cys Thr Gly Cys Tyr
SEQ ID NO: 1490  Cys Cys Csa Leu Cys Cys Asn Ala Ala Cys Ser Gly Cys Tyr
SEQ ID NO: 1491  Cys Cys Csa Leu Cys Cys Asn Ala Ala Cys 4F-Phe Gly Cys Tyr
SEQ ID NO: 1492  Cys Cys Csa Leu Cys Cys Asn Ala Ala Cys 4MeO-Phe Gly Cys Tyr
SEQ ID NO: 1493  Cys Cys Csa Leu Cys Cys Asn Ala Ala Cys 4NO2-Phe Gly Cys Tyr
SEQ ID NO: 1494  Cys Cys Csa Leu Cys Cys Asn Ala Ala Cys 5F-Phe Gly Cys Tyr
SEQ ID NO: 1495  Cys Cys Csa Leu Cys Cys Asn Ala Ala Cys 4MeF3-Phe Gly Cys Tyr
SEQ ID NO: 1496  Cys Cys Csa Leu Cys Cys Asn Dhp Ala Cys Ala D-Ala Cys Tyr
SEQ ID NO: 1497  Cys Cys Csa Leu Cys Cys Asn Thz Ala Cys Ala D-Ala Cys Tyr
SEQ ID NO: 1498  Cys Cys Csa Leu Cys Cys Asn HyPro Ala Cys Ala D-Ala Cys Tyr
SEQ ID NO: 1499  Cys Cys Csa Leu Cys Cys Asn Pip Ala Cys Ala D-Ala Cys Tyr
SEQ ID NO: 1500  Cys Cys Csa Leu Cys Cys Asn Ile Ala Cys Ala D-Ala Cys Tyr
SEQ ID NO: 1501  Cys Cys Csa Leu Cys Cys Asn Ala Ala Cys Ala D-Ala Cys Tyr
SEQ ID NO: 1502  Cys Cys Csa Leu Cys Cys Asn Dhp Ala Cys Ala Gly Cys Ile
SEQ ID NO: 1503  Cys Cys Csa Leu Cys Cys Asn Thz Ala Cys Ala Gly Cys Ile

TABLE 3C-continued

Triple substitutions from Scheme 1

```
SEQ ID NO: 1504  Cys Cys Csa  Leu Cys Cys Asn HyPro    Ala Cys Ala      Gly Cys Ile
SEQ ID NO: 1505  Cys Cys Csa  Leu Cys Cys Asn Pip      Ala Cys Ala      Gly Cys Ile
SEQ ID NO: 1506  Cys Cys Csa  Leu Cys Cys Asn Ile      Ala Cys Ala      Gly Cys Ile
SEQ ID NO: 1507  Cys Cys Csa  Leu Cys Cys Asn Ala      Ala Cys Ala      Gly Cys Ile
SEQ ID NO: 1508  Cys Cys Csa  Leu Cys Cys Asn Dhp      Ala Cys Ala      Gly Cys Trp
SEQ ID NO: 1509  Cys Cys Csa  Leu Cys Cys Asn Thz      Ala Cys Ala      Gly Cys Trp
SEQ ID NO: 1510  Cys Cys Csa  Leu Cys Cys Asn HyPro    Ala Cys Ala      Gly Cys Trp
SEQ ID NO: 1511  Cys Cys Csa  Leu Cys Cys Asn Pip      Ala Cys Ala      Gly Cys Trp
SEQ ID NO: 1512  Cys Cys Csa  Leu Cys Cys Asn Ile      Ala Cys Ala      Gly Cys Trp
SEQ ID NO: 1513  Cys Cys Csa  Leu Cys Cys Asn Ala      Ala Cys Ala      Gly Cys Trp
SEQ ID NO: 1514  Cys Cys Ser  Leu Cys Cys Asn Pro      Ala Cys Thr      D-Ala Cys Tyr
SEQ ID NO: 1515  Cys Cys Ser  Leu Cys Cys Asn Pro      Ala Cys Ser      D-Ala Cys Tyr
SEQ ID NO: 1516  Cys Cys Ser  Leu Cys Cys Asn Pro      Ala Cys 4F-Phe   D-Ala Cys Tyr
SEQ ID NO: 1517  Cys Cys Ser  Leu Cys Cys Asn Pro      Ala Cys 4MeO-Phe D-Ala Cys Tyr
SEQ ID NO: 1518  Cys Cys Ser  Leu Cys Cys Asn Pro      Ala Cys 4NO2-Phe D-Ala Cys Tyr
SEQ ID NO: 1519  Cys Cys Ser  Leu Cys Cys Asn Pro      Ala Cys 5F-Phe   D-Ala Cys Tyr
SEQ ID NO: 1520  Cys Cys Ser  Leu Cys Cys Asn Pro      Ala Cys 4MeF3-Phe D-Ala Cys Tyr
SEQ ID NO: 1521  Cys Cys Ser  Leu Cys Cys Asn Pro      Ala Cys Thr      Gly Cys Ile
SEQ ID NO: 1522  Cys Cys Ser  Leu Cys Cys Asn Pro      Ala Cys Ser      Gly Cys Ile
SEQ ID NO: 1523  Cys Cys Ser  Leu Cys Cys Asn Pro      Ala Cys 4F-Phe   Gly Cys Ile
SEQ ID NO: 1524  Cys Cys Ser  Leu Cys Cys Asn Pro      Ala Cys 4MeO-Phe Gly Cys Ile
SEQ ID NO: 1525  Cys Cys Ser  Leu Cys Cys Asn Pro      Ala Cys 4NO2-Phe Gly Cys Ile
SEQ ID NO: 1526  Cys Cys Ser  Leu Cys Cys Asn Pro      Ala Cys 5F-Phe   Gly Cys Ile
SEQ ID NO: 1527  Cys Cys Ser  Leu Cys Cys Asn Pro      Ala Cys 4MeF3-Phe Gly Cys Ile
SEQ ID NO: 1528  Cys Cys Ser  Leu Cys Cys Asn Pro      Ala Cys Thr      Gly Cys Trp
SEQ ID NO: 1529  Cys Cys Ser  Leu Cys Cys Asn Pro      Ala Cys Ser      Gly Cys Trp
SEQ ID NO: 1530  Cys Cys Ser  Leu Cys Cys Asn Pro      Ala Cys 4F-Phe   Gly Cys Trp
SEQ ID NO: 1531  Cys Cys Ser  Leu Cys Cys Asn Pro      Ala Cys 4MeO-Phe Gly Cys Trp
SEQ ID NO: 1532  Cys Cys Ser  Leu Cys Cys Asn Pro      Ala Cys 4NO2-Phe Gly Cys Trp
SEQ ID NO: 1533  Cys Cys Ser  Leu Cys Cys Asn Pro      Ala Cys 5F-Phe   Gly Cys Trp
SEQ ID NO: 1534  Cys Cys Ser  Leu Cys Cys Asn Pro      Ala Cys 4MeF3-Phe Gly Cys Trp
SEQ ID NO: 1535  Cys Cys hSer Leu Cys Cys Asn Pro      Ala Cys Thr      D-Ala Cys Tyr
SEQ ID NO: 1536  Cys Cys hSer Leu Cys Cys Asn Pro      Ala Cys Ser      D-Ala Cys Tyr
SEQ ID NO: 1537  Cys Cys hSer Leu Cys Cys Asn Pro      Ala Cys 4F-Phe   D-Ala Cys Tyr
SEQ ID NO: 1538  Cys Cys hSer Leu Cys Cys Asn Pro      Ala Cys 4MeO-Phe D-Ala Cys Tyr
SEQ ID NO: 1539  Cys Cys hSer Leu Cys Cys Asn Pro      Ala Cys 4NO2-Phe D-Ala Cys Tyr
SEQ ID NO: 1540  Cys Cys hSer Leu Cys Cys Asn Pro      Ala Cys 5F-Phe   D-Ala Cys Tyr
SEQ ID NO: 1541  Cys Cys hSer Leu Cys Cys Asn Pro      Ala Cys 4MeF3-Phe D-Ala Cys Tyr
SEQ ID NO: 1542  Cys Cys hSer Leu Cys Cys Asn Pro      Ala Cys Thr      Gly Cys Ile
```

TABLE 3C-continued

Triple substitutions from Scheme 1

SEQ ID NO: 1543  Cys Cys hSer Leu Cys Cys Asn Pro Ala Cys Ser Gly Cys Ile
SEQ ID NO: 1544  Cys Cys hSer Leu Cys Cys Asn Pro Ala Cys 4F-Phe Gly Cys Ile
SEQ ID NO: 1545  Cys Cys hSer Leu Cys Cys Asn Pro Ala Cys 4MeO-Phe Gly Cys Ile
SEQ ID NO: 1546  Cys Cys hSer Leu Cys Cys Asn Pro Ala Cys 4NO2-Phe Gly Cys Ile
SEQ ID NO: 1547  Cys Cys hSer Leu Cys Cys Asn Pro Ala Cys 5F-Phe Gly Cys Ile
SEQ ID NO: 1548  Cys Cys hSer Leu Cys Cys Asn Pro Ala Cys 4MeF3-Phe Gly Cys Ile
SEQ ID NO: 1549  Cys Cys hSer Leu Cys Cys Asn Pro Ala Cys Thr Gly Cys Trp
SEQ ID NO: 1550  Cys Cys hSer Leu Cys Cys Asn Pro Ala Cys Ser Gly Cys Trp
SEQ ID NO: 1551  Cys Cys hSer Leu Cys Cys Asn Pro Ala Cys 4F-Phe Gly Cys Trp
SEQ ID NO: 1552  Cys Cys hSer Leu Cys Cys Asn Pro Ala Cys 4MeO-Phe Gly Cys Trp
SEQ ID NO: 1553  Cys Cys hSer Leu Cys Cys Asn Pro Ala Cys 4NO2-Phe Gly Cys Trp
SEQ ID NO: 1554  Cys Cys hSer Leu Cys Cys Asn Pro Ala Cys 5F-Phe Gly Cys Trp
SEQ ID NO: 1555  Cys Cys hSer Leu Cys Cys Asn Pro Ala Cys 4MeF3-Phe Gly Cys Trp
SEQ ID NO: 1556  Cys Cys Csa Leu Cys Cys Asn Pro Ala Cys Thr D-Ala Cys Tyr
SEQ ID NO: 1557  Cys Cys Csa Leu Cys Cys Asn Pro Ala Cys Ser D-Ala Cys Tyr
SEQ ID NO: 1558  Cys Cys Csa Leu Cys Cys Asn Pro Ala Cys 4F-Phe D-Ala Cys Tyr
SEQ ID NO: 1559  Cys Cys Csa Leu Cys Cys Asn Pro Ala Cys 4MeO-Phe D-Ala Cys Tyr
SEQ ID NO: 1560  Cys Cys Csa Leu Cys Cys Asn Pro Ala Cys 4NO2-Phe D-Ala Cys Tyr
SEQ ID NO: 1561  Cys Cys Csa Leu Cys Cys Asn Pro Ala Cys 5F-Phe D-Ala Cys Tyr
SEQ ID NO: 1562  Cys Cys Csa Leu Cys Cys Asn Pro Ala Cys 4MeF3-Phe D-Ala Cys Tyr
SEQ ID NO: 1563  Cys Cys Csa Leu Cys Cys Asn Pro Ala Cys Thr Gly Cys Ile
SEQ ID NO: 1564  Cys Cys Csa Leu Cys Cys Asn Pro Ala Cys Ser Gly Cys Ile
SEQ ID NO: 1565  Cys Cys Csa Leu Cys Cys Asn Pro Ala Cys 4F-Phe Gly Cys Ile
SEQ ID NO: 1566  Cys Cys Csa Leu Cys Cys Asn Pro Ala Cys 4MeO-Phe Gly Cys Ile
SEQ ID NO: 1567  Cys Cys Csa Leu Cys Cys Asn Pro Ala Cys 4NO2-Phe Gly Cys Ile
SEQ ID NO: 1568  Cys Cys Csa Leu Cys Cys Asn Pro Ala Cys 5F-Phe Gly Cys Ile
SEQ ID NO: 1569  Cys Cys Csa Leu Cys Cys Asn Pro Ala Cys 4MeF3-Phe Gly Cys Ile
SEQ ID NO: 1570  Cys Cys Csa Leu Cys Cys Asn Pro Ala Cys Thr Gly Cys Trp
SEQ ID NO: 1571  Cys Cys Csa Leu Cys Cys Asn Pro Ala Cys Ser Gly Cys Trp
SEQ ID NO: 1572  Cys Cys Csa Leu Cys Cys Asn Pro Ala Cys 4F-Phe Gly Cys Trp
SEQ ID NO: 1573  Cys Cys Csa Leu Cys Cys Asn Pro Ala Cys 4MeO-Phe Gly Cys Trp
SEQ ID NO: 1574  Cys Cys Csa Leu Cys Cys Asn Pro Ala Cys 4NO2-Phe Gly Cys Trp
SEQ ID NO: 1575  Cys Cys Csa Leu Cys Cys Asn Pro Ala Cys 5F-Phe Gly Cys Trp
SEQ ID NO: 1576  Cys Cys Csa Leu Cys Cys Asn Pro Ala Cys 4MeF3-Phe Gly Cys Trp
SEQ ID NO: 1577  Cys Cys Ser Leu Cys Cys Asn Pro Ala Cys Ala D-Ala Cys Ile
SEQ ID NO: 1578  Cys Cys Ser Leu Cys Cys Asn Pro Ala Cys Ala D-Ala Cys Trp
SEQ ID NO: 1579  Cys Cys hSer Leu Cys Cys Asn Pro Ala Cys Ala D-Ala Cys Ile
SEQ ID NO: 1580  Cys Cys hSer Leu Cys Cys Asn Pro Ala Cys Ala D-Ala Cys Trp
SEQ ID NO: 1581  Cys Cys Csa Leu Cys Cys Asn Pro Ala Cys Ala D-Ala Cys Ile

TABLE 3C-continued

Triple substitutions from Scheme 1

SEQ ID NO: 1582  Cys Cys Csa Leu Cys Cys Asn Pro Ala Cys Ala D-Ala Cys Trp
SEQ ID NO: 1583  Cys Cys Glu Thr Cys Cys Asn Dhp Ala Cys Thr Gly Cys Tyr
SEQ ID NO: 1584  Cys Cys Glu Thr Cys Cys Asn Dhp Ala Cys Ser Gly Cys Tyr
SEQ ID NO: 1585  Cys Cys Glu Thr Cys Cys Asn Dhp Ala Cys 4F-Phe Gly Cys Tyr
SEQ ID NO: 1586  Cys Cys Glu Thr Cys Cys Asn Dhp Ala Cys 4MeO-Phe Gly Cys Tyr
SEQ ID NO: 1587  Cys Cys Glu Thr Cys Cys Asn Dhp Ala Cys 4NO2-Phe Gly Cys Tyr
SEQ ID NO: 1588  Cys Cys Glu Thr Cys Cys Asn Dhp Ala Cys 5F-Phe Gly Cys Tyr
SEQ ID NO: 1589  Cys Cys Glu Thr Cys Cys Asn Dhp Ala Cys 4MeF3-Phe Gly Cys Tyr
SEQ ID NO: 1590  Cys Cys Glu Thr Cys Cys Asn Thz Ala Cys Thr Gly Cys Tyr
SEQ ID NO: 1591  Cys Cys Glu Thr Cys Cys Asn Thz Ala Cys Ser Gly Cys Tyr
SEQ ID NO: 1592  Cys Cys Glu Thr Cys Cys Asn Thz Ala Cys 4F-Phe Gly Cys Tyr
SEQ ID NO: 1593  Cys Cys Glu Thr Cys Cys Asn Thz Ala Cys 4MeO-Phe Gly Cys Tyr
SEQ ID NO: 1594  Cys Cys Glu Thr Cys Cys Asn Thz Ala Cys 4NO2-Phe Gly Cys Tyr
SEQ ID NO: 1595  Cys Cys Glu Thr Cys Cys Asn Thz Ala Cys 5F-Phe Gly Cys Tyr
SEQ ID NO: 1596  Cys Cys Glu Thr Cys Cys Asn Thz Ala Cys 4MeF3-Phe Gly Cys Tyr
SEQ ID NO: 1597  Cys Cys Glu Thr Cys Cys Asn HyPro Ala Cys Thr Gly Cys Tyr
SEQ ID NO: 1598  Cys Cys Glu Thr Cys Cys Asn HyPro Ala Cys Ser Gly Cys Tyr
SEQ ID NO: 1599  Cys Cys Glu Thr Cys Cys Asn HyPro Ala Cys 4F-Phe Gly Cys Tyr
SEQ ID NO: 1600  Cys Cys Glu Thr Cys Cys Asn HyPro Ala Cys 4MeO-Phe Gly Cys Tyr
SEQ ID NO: 1601  Cys Cys Glu Thr Cys Cys Asn HyPro Ala Cys 4NO2-Phe Gly Cys Tyr
SEQ ID NO: 1602  Cys Cys Glu Thr Cys Cys Asn HyPro Ala Cys 5F-Phe Gly Cys Tyr
SEQ ID NO: 1603  Cys Cys Glu Thr Cys Cys Asn HyPro Ala Cys 4MeF3-Phe Gly Cys Tyr
SEQ ID NO: 1604  Cys Cys Glu Thr Cys Cys Asn Pip Ala Cys Thr Gly Cys Tyr
SEQ ID NO: 1605  Cys Cys Glu Thr Cys Cys Asn Pip Ala Cys Ser Gly Cys Tyr
SEQ ID NO: 1606  Cys Cys Glu Thr Cys Cys Asn Pip Ala Cys 4F-Phe Gly Cys Tyr
SEQ ID NO: 1607  Cys Cys Glu Thr Cys Cys Asn Pip Ala Cys 4MeO-Phe Gly Cys Tyr
SEQ ID NO: 1608  Cys Cys Glu Thr Cys Cys Asn Pip Ala Cys 4NO2-Phe Gly Cys Tyr
SEQ ID NO: 1609  Cys Cys Glu Thr Cys Cys Asn Pip Ala Cys 5F-Phe Gly Cys Tyr
SEQ ID NO: 1610  Cys Cys Glu Thr Cys Cys Asn Pip Ala Cys 4MeF3-Phe Gly Cys Tyr
SEQ ID NO: 1611  Cys Cys Glu Thr Cys Cys Asn Ile Ala Cys Thr Gly Cys Tyr
SEQ ID NO: 1612  Cys Cys Glu Thr Cys Cys Asn Ile Ala Cys Ser Gly Cys Tyr
SEQ ID NO: 1613  Cys Cys Glu Thr Cys Cys Asn Ile Ala Cys 4F-Phe Gly Cys Tyr
SEQ ID NO: 1614  Cys Cys Glu Thr Cys Cys Asn Ile Ala Cys 4MeO-Phe Gly Cys Tyr
SEQ ID NO: 1615  Cys Cys Glu Thr Cys Cys Asn Ile Ala Cys 4NO2-Phe Gly Cys Tyr
SEQ ID NO: 1616  Cys Cys Glu Thr Cys Cys Asn Ile Ala Cys 5F-Phe Gly Cys Tyr
SEQ ID NO: 1617  Cys Cys Glu Thr Cys Cys Asn Ile Ala Cys 4MeF3-Phe Gly Cys Tyr
SEQ ID NO: 1618  Cys Cys Glu Thr Cys Cys Asn Ala Ala Cys Thr Gly Cys Tyr
SEQ ID NO: 1619  Cys Cys Glu Thr Cys Cys Asn Ala Ala Cys Ser Gly Cys Tyr
SEQ ID NO: 1620  Cys Cys Glu Thr Cys Cys Asn Ala Ala Cys 4F-Phe Gly Cys Tyr

TABLE 3C-continued

Triple substitutions from Scheme 1

SEQ ID NO: 1621  Cys Cys Glu Thr Cys Cys Asn Ala Ala Cys 4MeO-Phe Gly Cys Tyr
SEQ ID NO: 1622  Cys Cys Glu Thr Cys Cys Asn Ala Ala Cys 4NO2-Phe Gly Cys Tyr
SEQ ID NO: 1623  Cys Cys Glu Thr Cys Cys Asn Ala Ala Cys 5F-Phe Gly Cys Tyr
SEQ ID NO: 1624  Cys Cys Glu Thr Cys Cys Asn Ala Ala Cys 4MeF3-Phe Gly Cys Tyr
SEQ ID NO: 1625  Cys Cys Glu Thr Cys Cys Asn Dhp Ala Cys Ala D-Ala Cys Tyr
SEQ ID NO: 1626  Cys Cys Glu Thr Cys Cys Asn Thz Ala Cys Ala D-Ala Cys Tyr
SEQ ID NO: 1627  Cys Cys Glu Thr Cys Cys Asn HyPro Ala Cys Ala D-Ala Cys Tyr
SEQ ID NO: 1628  Cys Cys Glu Thr Cys Cys Asn Pip Ala Cys Ala D-Ala Cys Tyr
SEQ ID NO: 1629  Cys Cys Glu Thr Cys Cys Asn Ile Ala Cys Ala D-Ala Cys Tyr
SEQ ID NO: 1630  Cys Cys Glu Thr Cys Cys Asn Ala Ala Cys Ala D-Ala Cys Tyr
SEQ ID NO: 1631  Cys Cys Glu Thr Cys Cys Asn Dhp Ala Cys Ala Gly Cys Ile
SEQ ID NO: 1632  Cys Cys Glu Thr Cys Cys Asn Thz Ala Cys Ala Gly Cys Ile
SEQ ID NO: 1633  Cys Cys Glu Thr Cys Cys Asn HyPro Ala Cys Ala Gly Cys Ile
SEQ ID NO: 1634  Cys Cys Glu Thr Cys Cys Asn Pip Ala Cys Ala Gly Cys Ile
SEQ ID NO: 1635  Cys Cys Glu Thr Cys Cys Asn Ile Ala Cys Ala Gly Cys Ile
SEQ ID NO: 1636  Cys Cys Glu Thr Cys Cys Asn Ala Ala Cys Ala Gly Cys Ile
SEQ ID NO: 1637  Cys Cys Glu Thr Cys Cys Asn Dhp Ala Cys Ala Gly Cys Trp
SEQ ID NO: 1638  Cys Cys Glu Thr Cys Cys Asn Thz Ala Cys Ala Gly Cys Trp
SEQ ID NO: 1639  Cys Cys Glu Thr Cys Cys Asn HyPro Ala Cys Ala Gly Cys Trp
SEQ ID NO: 1640  Cys Cys Glu Thr Cys Cys Asn Pip Ala Cys Ala Gly Cys Trp
SEQ ID NO: 1641  Cys Cys Glu Thr Cys Cys Asn Ile Ala Cys Ala Gly Cys Trp
SEQ ID NO: 1642  Cys Cys Glu Thr Cys Cys Asn Ala Ala Cys Ala Gly Cys Trp
SEQ ID NO: 1643  Cys Cys Glu hLeu Cys Cys Asn Dhp Ala Cys Thr Gly Cys Tyr
SEQ ID NO: 1644  Cys Cys Glu hLeu Cys Cys Asn Dhp Ala Cys Ser Gly Cys Tyr
SEQ ID NO: 1645  Cys Cys Glu hLeu Cys Cys Asn Dhp Ala Cys 4F-Phe Gly Cys Tyr
SEQ ID NO: 1646  Cys Cys Glu hLeu Cys Cys Asn Dhp Ala Cys 4MeO-Phe Gly Cys Tyr
SEQ ID NO: 1647  Cys Cys Glu hLeu Cys Cys Asn Dhp Ala Cys 4NO2-Phe Gly Cys Tyr
SEQ ID NO: 1648  Cys Cys Glu hLeu Cys Cys Asn Dhp Ala Cys 5F-Phe Gly Cys Tyr
SEQ ID NO: 1649  Cys Cys Glu hLeu Cys Cys Asn Dhp Ala Cys 4MeF3-Phe Gly Cys Tyr
SEQ ID NO: 1650  Cys Cys Glu hLeu Cys Cys Asn Thz Ala Cys Thr Gly Cys Tyr
SEQ ID NO: 1651  Cys Cys Glu hLeu Cys Cys Asn Thz Ala Cys Ser Gly Cys Tyr
SEQ ID NO: 1652  Cys Cys Glu hLeu Cys Cys Asn Thz Ala Cys 4F-Phe Gly Cys Tyr
SEQ ID NO: 1653  Cys Cys Glu hLeu Cys Cys Asn Thz Ala Cys 4MeO-Phe Gly Cys Tyr
SEQ ID NO: 1654  Cys Cys Glu hLeu Cys Cys Asn Thz Ala Cys 4NO2-Phe Gly Cys Tyr
SEQ ID NO: 1655  Cys Cys Glu hLeu Cys Cys Asn Thz Ala Cys 5F-Phe Gly Cys Tyr
SEQ ID NO: 1656  Cys Cys Glu hLeu Cys Cys Asn Thz Ala Cys 4MeF3-Phe Gly Cys Tyr
SEQ ID NO: 1657  Cys Cys Glu hLeu Cys Cys Asn HyPro Ala Cys Thr Gly Cys Tyr
SEQ ID NO: 1658  Cys Cys Glu hLeu Cys Cys Asn HyPro Ala Cys Ser Gly Cys Tyr
SEQ ID NO: 1659  Cys Cys Glu hLeu Cys Cys Asn HyPro Ala Cys 4F-Phe Gly Cys Tyr

TABLE 3C-continued

Triple substitutions from Scheme 1

SEQ ID NO: 1660  Cys Cys Glu hLeu Cys Cys Asn HyPro Ala Cys 4MeO-Phe Gly Cys Tyr
SEQ ID NO: 1661  Cys Cys Glu hLeu Cys Cys Asn HyPro Ala Cys 4NO2-Phe Gly Cys Tyr
SEQ ID NO: 1662  Cys Cys Glu hLeu Cys Cys Asn HyPro Ala Cys 5F-Phe Gly Cys Tyr
SEQ ID NO: 1663  Cys Cys Glu hLeu Cys Cys Asn HyPro Ala Cys 4MeF3-Phe Gly Cys Tyr
SEQ ID NO: 1664  Cys Cys Glu hLeu Cys Cys Asn Pip Ala Cys Thr Gly Cys Tyr
SEQ ID NO: 1665  Cys Cys Glu hLeu Cys Cys Asn Pip Ala Cys Ser Gly Cys Tyr
SEQ ID NO: 1666  Cys Cys Glu hLeu Cys Cys Asn Pip Ala Cys 4F-Phe Gly Cys Tyr
SEQ ID NO: 1667  Cys Cys Glu hLeu Cys Cys Asn Pip Ala Cys 4MeO-Phe Gly Cys Tyr
SEQ ID NO: 1668  Cys Cys Glu hLeu Cys Cys Asn Pip Ala Cys 4NO2-Phe Gly Cys Tyr
SEQ ID NO: 1669  Cys Cys Glu hLeu Cys Cys Asn Pip Ala Cys 5F-Phe Gly Cys Tyr
SEQ ID NO: 1670  Cys Cys Glu hLeu Cys Cys Asn Pip Ala Cys 4MeF3-Phe Gly Cys Tyr
SEQ ID NO: 1671  Cys Cys Glu hLeu Cys Cys Asn Ile Ala Cys Thr Gly Cys Tyr
SEQ ID NO: 1672  Cys Cys Glu hLeu Cys Cys Asn Ile Ala Cys Ser Gly Cys Tyr
SEQ ID NO: 1673  Cys Cys Glu hLeu Cys Cys Asn Ile Ala Cys 4F-Phe Gly Cys Tyr
SEQ ID NO: 1674  Cys Cys Glu hLeu Cys Cys Asn Ile Ala Cys 4MeO-Phe Gly Cys Tyr
SEQ ID NO: 1675  Cys Cys Glu hLeu Cys Cys Asn Ile Ala Cys 4NO2-Phe Gly Cys Tyr
SEQ ID NO: 1676  Cys Cys Glu hLeu Cys Cys Asn Ile Ala Cys 5F-Phe Gly Cys Tyr
SEQ ID NO: 1677  Cys Cys Glu hLeu Cys Cys Asn Ile Ala Cys 4MeF3-Phe Gly Cys Tyr
SEQ ID NO: 1678  Cys Cys Glu hLeu Cys Cys Asn Ala Ala Cys Thr Gly Cys Tyr
SEQ ID NO: 1679  Cys Cys Glu hLeu Cys Cys Asn Ala Ala Cys Ser Gly Cys Tyr
SEQ ID NO: 1680  Cys Cys Glu hLeu Cys Cys Asn Ala Ala Cys 4F-Phe Gly Cys Tyr
SEQ ID NO: 1681  Cys Cys Glu hLeu Cys Cys Asn Ala Ala Cys 4MeO-Phe Gly Cys Tyr
SEQ ID NO: 1682  Cys Cys Glu hLeu Cys Cys Asn Ala Ala Cys 4NO2-Phe Gly Cys Tyr
SEQ ID NO: 1683  Cys Cys Glu hLeu Cys Cys Asn Ala Ala Cys 5F-Phe Gly Cys Tyr
SEQ ID NO: 1684  Cys Cys Glu hLeu Cys Cys Asn Ala Ala Cys 4MeF3-Phe Gly Cys Tyr
SEQ ID NO: 1685  Cys Cys Glu hLeu Cys Cys Asn Dhp Ala Cys Ala D-Ala Cys Tyr
SEQ ID NO: 1686  Cys Cys Glu hLeu Cys Cys Asn Thz Ala Cys Ala D-Ala Cys Tyr
SEQ ID NO: 1687  Cys Cys Glu hLeu Cys Cys Asn HyPro Ala Cys Ala D-Ala Cys Tyr
SEQ ID NO: 1688  Cys Cys Glu hLeu Cys Cys Asn Pip Ala Cys Ala D-Ala Cys Tyr
SEQ ID NO: 1689  Cys Cys Glu hLeu Cys Cys Asn Ile Ala Cys Ala D-Ala Cys Tyr
SEQ ID NO: 1690  Cys Cys Glu hLeu Cys Cys Asn Ala Ala Cys Ala D-Ala Cys Tyr
SEQ ID NO: 1691  Cys Cys Glu hLeu Cys Cys Asn Dhp Ala Cys Ala Gly Cys Ile
SEQ ID NO: 1692  Cys Cys Glu hLeu Cys Cys Asn Thz Ala Cys Ala Gly Cys Ile
SEQ ID NO: 1693  Cys Cys Glu hLeu Cys Cys Asn HyPro Ala Cys Ala Gly Cys Ile
SEQ ID NO: 1694  Cys Cys Glu hLeu Cys Cys Asn Pip Ala Cys Ala Gly Cys Ile
SEQ ID NO: 1695  Cys Cys Glu hLeu Cys Cys Asn Ile Ala Cys Ala Gly Cys Ile
SEQ ID NO: 1696  Cys Cys Glu hLeu Cys Cys Asn Ala Ala Cys Ala Gly Cys Ile
SEQ ID NO: 1697  Cys Cys Glu hLeu Cys Cys Asn Dhp Ala Cys Ala Gly Cys Trp
SEQ ID NO: 1698  Cys Cys Glu hLeu Cys Cys Asn Thz Ala Cys Ala Gly Cys Trp

TABLE 3C-continued

Triple substitutions from Scheme 1

| | | |
|---|---|---|
| SEQ ID NO: 1699 | Cys Cys Glu hLeu Cys Cys Asn HyPro Ala Cys Ala Gly Cys Trp |
| SEQ ID NO: 1700 | Cys Cys Glu hLeu Cys Cys Asn Pip Ala Cys Ala Gly Cys Trp |
| SEQ ID NO: 1701 | Cys Cys Glu hLeu Cys Cys Asn Ile Ala Cys Ala Gly Cys Trp |
| SEQ ID NO: 1702 | Cys Cys Glu hLeu Cys Cys Asn Ala Ala Cys Ala Gly Cys Trp |
| SEQ ID NO: 1703 | Cys Cys Glu norLeu Cys Cys Asn Dhp Ala Cys Thr Gly Cys Tyr |
| SEQ ID NO: 1704 | Cys Cys Glu norLeu Cys Cys Asn Dhp Ala Cys Ser Gly Cys Tyr |
| SEQ ID NO: 1705 | Cys Cys Glu norLeu Cys Cys Asn Dhp Ala Cys 4F-Phe Gly Cys Tyr |
| SEQ ID NO: 1706 | Cys Cys Glu norLeu Cys Cys Asn Dhp Ala Cys 4MeO-Phe Gly Cys Tyr |
| SEQ ID NO: 1707 | Cys Cys Glu norLeu Cys Cys Asn Dhp Ala Cys 4NO2-Phe Gly Cys Tyr |
| SEQ ID NO: 1708 | Cys Cys Glu norLeu Cys Cys Asn Dhp Ala Cys 5F-Phe Gly Cys Tyr |
| SEQ ID NO: 1709 | Cys Cys Glu norLeu Cys Cys Asn Dhp Ala Cys 4MeF3-Phe Gly Cys Tyr |
| SEQ ID NO: 1710 | Cys Cys Glu norLeu Cys Cys Asn Thz Ala Cys Thr Gly Cys Tyr |
| SEQ ID NO: 1711 | Cys Cys Glu norLeu Cys Cys Asn Thz Ala Cys Ser Gly Cys Tyr |
| SEQ ID NO: 1712 | Cys Cys Glu norLeu Cys Cys Asn Thz Ala Cys 4F-Phe Gly Cys Tyr |
| SEQ ID NO: 1713 | Cys Cys Glu norLeu Cys Cys Asn Thz Ala Cys 4MeO-Phe Gly Cys Tyr |
| SEQ ID NO: 1714 | Cys Cys Glu norLeu Cys Cys Asn Thz Ala Cys 4NO2-Phe Gly Cys Tyr |
| SEQ ID NO: 1715 | Cys Cys Glu norLeu Cys Cys Asn Thz Ala Cys 5F-Phe Gly Cys Tyr |
| SEQ ID NO: 1716 | Cys Cys Glu norLeu Cys Cys Asn Thz Ala Cys 4MeF3-Phe Gly Cys Tyr |
| SEQ ID NO: 1717 | Cys Cys Glu norLeu Cys Cys Asn HyPro Ala Cys Thr Gly Cys Tyr |
| SEQ ID NO: 1718 | Cys Cys Glu norLeu Cys Cys Asn HyPro Ala Cys Ser Gly Cys Tyr |
| SEQ ID NO: 1719 | Cys Cys Glu norLeu Cys Cys Asn HyPro Ala Cys 4F-Phe Gly Cys Tyr |
| SEQ ID NO: 1720 | Cys Cys Glu norLeu Cys Cys Asn HyPro Ala Cys 4MeO-Phe Gly Cys Tyr |
| SEQ ID NO: 1721 | Cys Cys Glu norLeu Cys Cys Asn HyPro Ala Cys 4NO2-Phe Gly Cys Tyr |
| SEQ ID NO: 1722 | Cys Cys Glu norLeu Cys Cys Asn HyPro Ala Cys 5F-Phe Gly Cys Tyr |
| SEQ ID NO: 1723 | Cys Cys Glu norLeu Cys Cys Asn HyPro Ala Cys 4MeF3-Phe Gly Cys Tyr |
| SEQ ID NO: 1724 | Cys Cys Glu norLeu Cys Cys Asn Pip Ala Cys Thr Gly Cys Tyr |
| SEQ ID NO: 1725 | Cys Cys Glu norLeu Cys Cys Asn Pip Ala Cys Ser Gly Cys Tyr |
| SEQ ID NO: 1726 | Cys Cys Glu norLeu Cys Cys Asn Pip Ala Cys 4F-Phe Gly Cys Tyr |
| SEQ ID NO: 1727 | Cys Cys Glu norLeu Cys Cys Asn Pip Ala Cys 4MeO-Phe Gly Cys Tyr |
| SEQ ID NO: 1728 | Cys Cys Glu norLeu Cys Cys Asn Pip Ala Cys 4NO2-Phe Gly Cys Tyr |
| SEQ ID NO: 1729 | Cys Cys Glu norLeu Cys Cys Asn Pip Ala Cys 5F-Phe Gly Cys Tyr |
| SEQ ID NO: 1730 | Cys Cys Glu norLeu Cys Cys Asn Pip Ala Cys 4MeF3-Phe Gly Cys Tyr |
| SEQ ID NO: 1731 | Cys Cys Glu norLeu Cys Cys Asn Ile Ala Cys Thr Gly Cys Tyr |
| SEQ ID NO: 1732 | Cys Cys Glu norLeu Cys Cys Asn Ile Ala Cys Ser Gly Cys Tyr |
| SEQ ID NO: 1733 | Cys Cys Glu norLeu Cys Cys Asn Ile Ala Cys 4F-Phe Gly Cys Tyr |
| SEQ ID NO: 1734 | Cys Cys Glu norLeu Cys Cys Asn Ile Ala Cys 4MeO-Phe Gly Cys Tyr |
| SEQ ID NO: 1735 | Cys Cys Glu norLeu Cys Cys Asn Ile Ala Cys 4NO2-Phe Gly Cys Tyr |
| SEQ ID NO: 1736 | Cys Cys Glu norLeu Cys Cys Asn Ile Ala Cys 5F-Phe Gly Cys Tyr |
| SEQ ID NO: 1737 | Cys Cys Glu norLeu Cys Cys Asn Ile Ala Cys 4MeF3-Phe Gly Cys Tyr |

TABLE 3C-continued

Triple substitutions from Scheme 1

SEQ ID NO: 1738  Cys Cys Glu norLeu Cys Cys Asn Ala Ala Cys Thr Gly Cys Tyr
SEQ ID NO: 1739  Cys Cys Glu norLeu Cys Cys Asn Ala Ala Cys Ser Gly Cys Tyr
SEQ ID NO: 1740  Cys Cys Glu norLeu Cys Cys Asn Ala Ala Cys 4F-Phe Gly Cys Tyr
SEQ ID NO: 1741  Cys Cys Glu norLeu Cys Cys Asn Ala Ala Cys 4MeO-Phe Gly Cys Tyr
SEQ ID NO: 1742  Cys Cys Glu norLeu Cys Cys Asn Ala Ala Cys 4NO2-Phe Gly Cys Tyr
SEQ ID NO: 1743  Cys Cys Glu norLeu Cys Cys Asn Ala Ala Cys 5F-Phe Gly Cys Tyr
SEQ ID NO: 1744  Cys Cys Glu norLeu Cys Cys Asn Ala Ala Cys 4MeF3-Phe Gly Cys Tyr
SEQ ID NO: 1745  Cys Cys Glu norLeu Cys Cys Asn Dhp Ala Cys Ala D-Ala Cys Tyr
SEQ ID NO: 1746  Cys Cys Glu norLeu Cys Cys Asn Thz Ala Cys Ala D-Ala Cys Tyr
SEQ ID NO: 1747  Cys Cys Glu norLeu Cys Cys Asn HyPro Ala Cys Ala D-Ala Cys Tyr
SEQ ID NO: 1748  Cys Cys Glu norLeu Cys Cys Asn Pip Ala Cys Ala D-Ala Cys Tyr
SEQ ID NO: 1749  Cys Cys Glu norLeu Cys Cys Asn Ile Ala Cys Ala D-Ala Cys Tyr
SEQ ID NO: 1750  Cys Cys Glu norLeu Cys Cys Asn Ala Ala Cys Ala D-Ala Cys Tyr
SEQ ID NO: 1751  Cys Cys Glu norLeu Cys Cys Asn Dhp Ala Cys Ala Gly Cys Ile
SEQ ID NO: 1752  Cys Cys Glu norLeu Cys Cys Asn Thz Ala Cys Ala Gly Cys Ile
SEQ ID NO: 1753  Cys Cys Glu norLeu Cys Cys Asn HyPro Ala Cys Ala Gly Cys Ile
SEQ ID NO: 1754  Cys Cys Glu norLeu Cys Cys Asn Pip Ala Cys Ala Gly Cys Ile
SEQ ID NO: 1755  Cys Cys Glu norLeu Cys Cys Asn Ile Ala Cys Ala Gly Cys Ile
SEQ ID NO: 1756  Cys Cys Glu norLeu Cys Cys Asn Ala Ala Cys Ala Gly Cys Ile
SEQ ID NO: 1757  Cys Cys Glu norLeu Cys Cys Asn Dhp Ala Cys Ala Gly Cys Trp
SEQ ID NO: 1758  Cys Cys Glu norLeu Cys Cys Asn Thz Ala Cys Ala Gly Cys Trp
SEQ ID NO: 1759  Cys Cys Glu norLeu Cys Cys Asn HyPro Ala Cys Ala Gly Cys Trp
SEQ ID NO: 1760  Cys Cys Glu norLeu Cys Cys Asn Pip Ala Cys Ala Gly Cys Trp
SEQ ID NO: 1761  Cys Cys Glu norLeu Cys Cys Asn Ile Ala Cys Ala Gly Cys Trp
SEQ ID NO: 1762  Cys Cys Glu norLeu Cys Cys Asn Ala Ala Cys Ala Gly Cys Trp
SEQ ID NO: 1763  Cys Cys Glu ChxAla Cys Cys Asn Dhp Ala Cys Thr Gly Cys Tyr
SEQ ID NO: 1764  Cys Cys Glu ChxAla Cys Cys Asn Dhp Ala Cys Ser Gly Cys Tyr
SEQ ID NO: 1765  Cys Cys Glu ChxAla Cys Cys Asn Dhp Ala Cys 4F-Phe Gly Cys Tyr
SEQ ID NO: 1766  Cys Cys Glu ChxAla Cys Cys Asn Dhp Ala Cys 4MeO-Phe Gly Cys Tyr
SEQ ID NO: 1767  Cys Cys Glu ChxAla Cys Cys Asn Dhp Ala Cys 4NO2-Phe Gly Cys Tyr
SEQ ID NO: 1768  Cys Cys Glu ChxAla Cys Cys Asn Dhp Ala Cys 5F-Phe Gly Cys Tyr
SEQ ID NO: 1769  Cys Cys Glu ChxAla Cys Cys Asn Dhp Ala Cys 4MeF3-Phe Gly Cys Tyr
SEQ ID NO: 1770  Cys Cys Glu ChxAla Cys Cys Asn Thz Ala Cys Thr Gly Cys Tyr
SEQ ID NO: 1771  Cys Cys Glu ChxAla Cys Cys Asn Thz Ala Cys Ser Gly Cys Tyr
SEQ ID NO: 1772  Cys Cys Glu ChxAla Cys Cys Asn Thz Ala Cys 4F-Phe Gly Cys Tyr
SEQ ID NO: 1773  Cys Cys Glu ChxAla Cys Cys Asn Thz Ala Cys 4MeO-Phe Gly Cys Tyr
SEQ ID NO: 1774  Cys Cys Glu ChxAla Cys Cys Asn Thz Ala Cys 4NO2-Phe Gly Cys Tyr
SEQ ID NO: 1775  Cys Cys Glu ChxAla Cys Cys Asn Thz Ala Cys 5F-Phe Gly Cys Tyr
SEQ ID NO: 1776  Cys Cys Glu ChxAla Cys Cys Asn Thz Ala Cys 4MeF3-Phe Gly Cys Tyr TABLE 3C-continued Triple substitutions from Scheme 1

```
SEQ ID NO: 1777  Cys Cys Glu ChxAla Cys Cys Asn HyPro Ala Cys Thr Gly Cys Tyr
SEQ ID NO: 1778  Cys Cys Glu ChxAla Cys Cys Asn HyPro Ala Cys Ser Gly Cys Tyr
SEQ ID NO: 1779  Cys Cys Glu ChxAla Cys Cys Asn HyPro Ala Cys 4F-Phe Gly Cys Tyr
SEQ ID NO: 1780  Cys Cys Glu ChxAla Cys Cys Asn HyPro Ala Cys 4MeO-Phe Gly Cys Tyr
SEQ ID NO: 1781  Cys Cys Glu ChxAla Cys Cys Asn HyPro Ala Cys 4NO2-Phe Gly Cys Tyr
SEQ ID NO: 1782  Cys Cys Glu ChxAla Cys Cys Asn HyPro Ala Cys 5F-Phe Gly Cys Tyr
SEQ ID NO: 1783  Cys Cys Glu ChxAla Cys Cys Asn HyPro Ala Cys 4MeF3-Phe Gly Cys Tyr
SEQ ID NO: 1784  Cys Cys Glu ChxAla Cys Cys Asn Pip Ala Cys Thr Gly Cys Tyr
SEQ ID NO: 1785  Cys Cys Glu ChxAla Cys Cys Asn Pip Ala Cys Ser Gly Cys Tyr
SEQ ID NO: 1786  Cys Cys Glu ChxAla Cys Cys Asn Pip Ala Cys 4F-Phe Gly Cys Tyr
SEQ ID NO: 1787  Cys Cys Glu ChxAla Cys Cys Asn Pip Ala Cys 4MeO-Phe Gly Cys Tyr
SEQ ID NO: 1788  Cys Cys Glu ChxAla Cys Cys Asn Pip Ala Cys 4NO2-Phe Gly Cys Tyr
SEQ ID NO: 1789  Cys Cys Glu ChxAla Cys Cys Asn Pip Ala Cys 5F-Phe Gly Cys Tyr
SEQ ID NO: 1790  Cys Cys Glu ChxAla Cys Cys Asn Pip Ala Cys 4MeF3-Phe Gly Cys Tyr
SEQ ID NO: 1791  Cys Cys Glu ChxAla Cys Cys Asn Ile Ala Cys Thr Gly Cys Tyr
SEQ ID NO: 1792  Cys Cys Glu ChxAla Cys Cys Asn Ile Ala Cys Ser Gly Cys Tyr
SEQ ID NO: 1793  Cys Cys Glu ChxAla Cys Cys Asn Ile Ala Cys 4F-Phe Gly Cys Tyr
SEQ ID NO: 1794  Cys Cys Glu ChxAla Cys Cys Asn Ile Ala Cys 4MeO-Phe Gly Cys Tyr
SEQ ID NO: 1795  Cys Cys Glu ChxAla Cys Cys Asn Ile Ala Cys 4NO2-Phe Gly Cys Tyr
SEQ ID NO: 1796  Cys Cys Glu ChxAla Cys Cys Asn Ile Ala Cys 5F-Phe Gly Cys Tyr
SEQ ID NO: 1797  Cys Cys Glu ChxAla Cys Cys Asn Ile Ala Cys 4MeF3-Phe Gly Cys Tyr
SEQ ID NO: 1798  Cys Cys Glu ChxAla Cys Cys Asn Ala Ala Cys Thr Gly Cys Tyr
SEQ ID NO: 1799  Cys Cys Glu ChxAla Cys Cys Asn Ala Ala Cys Ser Gly Cys Tyr
SEQ ID NO: 1800  Cys Cys Glu ChxAla Cys Cys Asn Ala Ala Cys 4F-Phe Gly Cys Tyr
SEQ ID NO: 1801  Cys Cys Glu ChxAla Cys Cys Asn Ala Ala Cys 4MeO-Phe Gly Cys Tyr
SEQ ID NO: 1802  Cys Cys Glu ChxAla Cys Cys Asn Ala Ala Cys 4NO2-Phe Gly Cys Tyr
SEQ ID NO: 1803  Cys Cys Glu ChxAla Cys Cys Asn Ala Ala Cys 5F-Phe Gly Cys Tyr
SEQ ID NO: 1804  Cys Cys Glu ChxAla Cys Cys Asn Ala Ala Cys 4MeF3-Phe Gly Cys Tyr
SEQ ID NO: 1805  Cys Cys Glu ChxAla Cys Cys Asn Dhp Ala Cys Ala D-Ala Cys Tyr
SEQ ID NO: 1806  Cys Cys Glu ChxAla Cys Cys Asn Thz Ala Cys Ala D-Ala Cys Tyr
SEQ ID NO: 1807  Cys Cys Glu ChxAla Cys Cys Asn HyPro Ala Cys Ala D-Ala Cys Tyr
SEQ ID NO: 1808  Cys Cys Glu ChxAla Cys Cys Asn Pip Ala Cys Ala D-Ala Cys Tyr
SEQ ID NO: 1809  Cys Cys Glu ChxAla Cys Cys Asn Ile Ala Cys Ala D-Ala Cys Tyr
SEQ ID NO: 1810  Cys Cys Glu ChxAla Cys Cys Asn Ala Ala Cys Ala D-Ala Cys Tyr
SEQ ID NO: 1811  Cys Cys Glu ChxAla Cys Cys Asn Dhp Ala Cys Ala Gly Cys Ile
SEQ ID NO: 1812  Cys Cys Glu ChxAla Cys Cys Asn Thz Ala Cys Ala Gly Cys Ile
SEQ ID NO: 1813  Cys Cys Glu ChxAla Cys Cys Asn HyPro Ala Cys Ala Gly Cys Ile
SEQ ID NO: 1814  Cys Cys Glu ChxAla Cys Cys Asn Pip Ala Cys Ala Gly Cys Ile
SEQ ID NO: 1815  Cys Cys Glu ChxAla Cys Cys Asn Ile Ala Cys Ala Gly Cys Ile
```

TABLE 3C-continued

Triple substitutions from Scheme 1

SEQ ID NO: 1816  Cys Cys Glu ChxAla Cys Cys Asn Ala Ala Cys Ala Gly Cys Ile
SEQ ID NO: 1817  Cys Cys Glu ChxAla Cys Cys Asn Dhp Ala Cys Ala Gly Cys Trp
SEQ ID NO: 1818  Cys Cys Glu ChxAla Cys Cys Asn Thz Ala Cys Ala Gly Cys Trp
SEQ ID NO: 1819  Cys Cys Glu ChxAla Cys Cys Asn HyPro Ala Cys Ala Gly Cys Trp
SEQ ID NO: 1820  Cys Cys Glu ChxAla Cys Cys Asn Pip Ala Cys Ala Gly Cys Trp
SEQ ID NO: 1821  Cys Cys Glu ChxAla Cys Cys Asn Ile Ala Cys Ala Gly Cys Trp
SEQ ID NO: 1822  Cys Cys Glu ChxAla Cys Cys Asn Ala Ala Cys Ala Gly Cys Trp
SEQ ID NO: 1823  Cys Cys Glu ChxIle Cys Cys Asn Dhp Ala Cys Thr Gly Cys Tyr
SEQ ID NO: 1824  Cys Cys Glu ChxIle Cys Cys Asn Dhp Ala Cys Ser Gly Cys Tyr
SEQ ID NO: 1825  Cys Cys Glu ChxIle Cys Cys Asn Dhp Ala Cys 4F-Phe Gly Cys Tyr
SEQ ID NO: 1826  Cys Cys Glu ChxIle Cys Cys Asn Dhp Ala Cys 4MeO-Phe Gly Cys Tyr
SEQ ID NO: 1827  Cys Cys Glu ChxIle Cys Cys Asn Dhp Ala Cys 4NO2-Phe Gly Cys Tyr
SEQ ID NO: 1828  Cys Cys Glu ChxIle Cys Cys Asn Dhp Ala Cys 5F-Phe Gly Cys Tyr
SEQ ID NO: 1829  Cys Cys Glu ChxIle Cys Cys Asn Dhp Ala Cys 4MeF3-Phe Gly Cys Tyr
SEQ ID NO: 1830  Cys Cys Glu ChxIle Cys Cys Asn Thz Ala Cys Thr Gly Cys Tyr
SEQ ID NO: 1831  Cys Cys Glu ChxIle Cys Cys Asn Thz Ala Cys Ser Gly Cys Tyr
SEQ ID NO: 1832  Cys Cys Glu ChxIle Cys Cys Asn Thz Ala Cys 4F-Phe Gly Cys Tyr
SEQ ID NO: 1833  Cys Cys Glu ChxIle Cys Cys Asn Thz Ala Cys 4MeO-Phe Gly Cys Tyr
SEQ ID NO: 1834  Cys Cys Glu ChxIle Cys Cys Asn Thz Ala Cys 4NO2-Phe Gly Cys Tyr
SEQ ID NO: 1835  Cys Cys Glu ChxIle Cys Cys Asn Thz Ala Cys 5F-Phe Gly Cys Tyr
SEQ ID NO: 1836  Cys Cys Glu ChxIle Cys Cys Asn Thz Ala Cys 4MeF3-Phe Gly Cys Tyr
SEQ ID NO: 1837  Cys Cys Glu ChxIle Cys Cys Asn HyPro Ala Cys Thr Gly Cys Tyr
SEQ ID NO: 1838  Cys Cys Glu ChxIle Cys Cys Asn HyPro Ala Cys Ser Gly Cys Tyr
SEQ ID NO: 1839  Cys Cys Glu ChxIle Cys Cys Asn HyPro Ala Cys 4F-Phe Gly Cys Tyr
SEQ ID NO: 1840  Cys Cys Glu ChxIle Cys Cys Asn HyPro Ala Cys 4MeO-Phe Gly Cys Tyr
SEQ ID NO: 1841  Cys Cys Glu ChxIle Cys Cys Asn HyPro Ala Cys 4NO2-Phe Gly Cys Tyr
SEQ ID NO: 1842  Cys Cys Glu ChxIle Cys Cys Asn HyPro Ala Cys 5F-Phe Gly Cys Tyr
SEQ ID NO: 1843  Cys Cys Glu ChxIle Cys Cys Asn HyPro Ala Cys 4MeF3-Phe Gly Cys Tyr
SEQ ID NO: 1844  Cys Cys Glu ChxIle Cys Cys Asn Pip Ala Cys Thr Gly Cys Tyr
SEQ ID NO: 1845  Cys Cys Glu ChxIle Cys Cys Asn Pip Ala Cys Ser Gly Cys Tyr
SEQ ID NO: 1846  Cys Cys Glu ChxIle Cys Cys Asn Pip Ala Cys 4F-Phe Gly Cys Tyr
SEQ ID NO: 1847  Cys Cys Glu ChxIle Cys Cys Asn Pip Ala Cys 4MeO-Phe Gly Cys Tyr
SEQ ID NO: 1848  Cys Cys Glu ChxIle Cys Cys Asn Pip Ala Cys 4NO2-Phe Gly Cys Tyr
SEQ ID NO: 1849  Cys Cys Glu ChxIle Cys Cys Asn Pip Ala Cys 5F-Phe Gly Cys Tyr
SEQ ID NO: 1850  Cys Cys Glu ChxIle Cys Cys Asn Pip Ala Cys 4MeF3-Phe Gly Cys Tyr
SEQ ID NO: 1851  Cys Cys Glu ChxIle Cys Cys Asn Ile Ala Cys Thr Gly Cys Tyr
SEQ ID NO: 1852  Cys Cys Glu ChxIle Cys Cys Asn Ile Ala Cys Ser Gly Cys Tyr
SEQ ID NO: 1853  Cys Cys Glu ChxIle Cys Cys Asn Ile Ala Cys 4F-Phe Gly Cys Tyr
SEQ ID NO: 1854  Cys Cys Glu ChxIle Cys Cys Asn Ile Ala Cys 4MeO-Phe Gly Cys Tyr

TABLE 3C-continued

Triple substitutions from Scheme 1

SEQ ID NO: 1855  Cys Cys Glu ChxIle Cys Cys Asn Ile Ala Cys 4NO2-Phe Gly Cys Tyr
SEQ ID NO: 1856  Cys Cys Glu ChxIle Cys Cys Asn Ile Ala Cys 5F-Phe Gly Cys Tyr
SEQ ID NO: 1857  Cys Cys Glu ChxIle Cys Cys Asn Ile Ala Cys 4MeF3-Phe Gly Cys Tyr
SEQ ID NO: 1858  Cys Cys Glu ChxIle Cys Cys Asn Ala Ala Cys Thr Gly Cys Tyr
SEQ ID NO: 1859  Cys Cys Glu ChxIle Cys Cys Asn Ala Ala Cys Ser Gly Cys Tyr
SEQ ID NO: 1860  Cys Cys Glu ChxIle Cys Cys Asn Ala Ala Cys 4F-Phe Gly Cys Tyr
SEQ ID NO: 1861  Cys Cys Glu ChxIle Cys Cys Asn Ala Ala Cys 4MeO-Phe Gly Cys Tyr
SEQ ID NO: 1862  Cys Cys Glu ChxIle Cys Cys Asn Ala Ala Cys 4NO2-Phe Gly Cys Tyr
SEQ ID NO: 1863  Cys Cys Glu ChxIle Cys Cys Asn Ala Ala Cys 5F-Phe Gly Cys Tyr
SEQ ID NO: 1864  Cys Cys Glu ChxIle Cys Cys Asn Ala Ala Cys 4MeF3-Phe Gly Cys Tyr
SEQ ID NO: 1865  Cys Cys Glu ChxIle Cys Cys Asn Dhp Ala Cys Ala D-Ala Cys Tyr
SEQ ID NO: 1866  Cys Cys Glu ChxIle Cys Cys Asn Thz Ala Cys Ala D-Ala Cys Tyr
SEQ ID NO: 1867  Cys Cys Glu ChxIle Cys Cys Asn HyPro Ala Cys Ala D-Ala Cys Tyr
SEQ ID NO: 1868  Cys Cys Glu ChxIle Cys Cys Asn Pip Ala Cys Ala D-Ala Cys Tyr
SEQ ID NO: 1869  Cys Cys Glu ChxIle Cys Cys Asn Ile Ala Cys Ala D-Ala Cys Tyr
SEQ ID NO: 1870  Cys Cys Glu ChxIle Cys Cys Asn Ala Ala Cys Ala D-Ala Cys Tyr
SEQ ID NO: 1871  Cys Cys Glu ChxIle Cys Cys Asn Dhp Ala Cys Ala Gly Cys Ile
SEQ ID NO: 1872  Cys Cys Glu ChxIle Cys Cys Asn Thz Ala Cys Ala Gly Cys Ile
SEQ ID NO: 1873  Cys Cys Glu ChxIle Cys Cys Asn HyPro Ala Cys Ala Gly Cys Ile
SEQ ID NO: 1874  Cys Cys Glu ChxIle Cys Cys Asn Pip Ala Cys Ala Gly Cys Ile
SEQ ID NO: 1875  Cys Cys Glu ChxIle Cys Cys Asn Ile Ala Cys Ala Gly Cys Ile
SEQ ID NO: 1876  Cys Cys Glu ChxIle Cys Cys Asn Ala Ala Cys Ala Gly Cys Ile
SEQ ID NO: 1877  Cys Cys Glu ChxIle Cys Cys Asn Dhp Ala Cys Ala Gly Cys Trp
SEQ ID NO: 1878  Cys Cys Glu ChxIle Cys Cys Asn Thz Ala Cys Ala Gly Cys Trp
SEQ ID NO: 1879  Cys Cys Glu ChxIle Cys Cys Asn HyPro Ala Cys Ala Gly Cys Trp
SEQ ID NO: 1880  Cys Cys Glu ChxIle Cys Cys Asn Pip Ala Cys Ala Gly Cys Trp
SEQ ID NO: 1881  Cys Cys Glu ChxIle Cys Cys Asn Ile Ala Cys Ala Gly Cys Trp
SEQ ID NO: 1882  Cys Cys Glu ChxIle Cys Cys Asn Ala Ala Cys Ala Gly Cys Trp
SEQ ID NO: 1883  Cys Cys Glu Phe Cys Cys Asn Dhp Ala Cys Thr Gly Cys Tyr
SEQ ID NO: 1884  Cys Cys Glu Phe Cys Cys Asn Dhp Ala Cys Ser Gly Cys Tyr
SEQ ID NO: 1885  Cys Cys Glu Phe Cys Cys Asn Dhp Ala Cys 4F-Phe Gly Cys Tyr
SEQ ID NO: 1886  Cys Cys Glu Phe Cys Cys Asn Dhp Ala Cys 4MeO-Phe Gly Cys Tyr
SEQ ID NO: 1887  Cys Cys Glu Phe Cys Cys Asn Dhp Ala Cys 4NO2-Phe Gly Cys Tyr
SEQ ID NO: 1888  Cys Cys Glu Phe Cys Cys Asn Dhp Ala Cys 5F-Phe Gly Cys Tyr
SEQ ID NO: 1889  Cys Cys Glu Phe Cys Cys Asn Dhp Ala Cys 4MeF3-Phe Gly Cys Tyr
SEQ ID NO: 1890  Cys Cys Glu Phe Cys Cys Asn Thz Ala Cys Thr Gly Cys Tyr
SEQ ID NO: 1891  Cys Cys Glu Phe Cys Cys Asn Thz Ala Cys Ser Gly Cys Tyr
SEQ ID NO: 1892  Cys Cys Glu Phe Cys Cys Asn Thz Ala Cys 4F-Phe Gly Cys Tyr
SEQ ID NO: 1893  Cys Cys Glu Phe Cys Cys Asn Thz Ala Cys 4MeO-Phe Gly Cys Tyr

TABLE 3C-continued

Triple substitutions from Scheme 1

SEQ ID NO: 1894  Cys Cys Glu Phe Cys Cys Asn Thz Ala Cys 4NO2-Phe Gly Cys Tyr
SEQ ID NO: 1895  Cys Cys Glu Phe Cys Cys Asn Thz Ala Cys 5F-Phe Gly Cys Tyr
SEQ ID NO: 1896  Cys Cys Glu Phe Cys Cys Asn Thz Ala Cys 4MeF3-Phe Gly Cys Tyr
SEQ ID NO: 1897  Cys Cys Glu Phe Cys Cys Asn HyPro Ala Cys Thr Gly Cys Tyr
SEQ ID NO: 1898  Cys Cys Glu Phe Cys Cys Asn HyPro Ala Cys Ser Gly Cys Tyr
SEQ ID NO: 1899  Cys Cys Glu Phe Cys Cys Asn HyPro Ala Cys 4F-Phe Gly Cys Tyr
SEQ ID NO: 1900  Cys Cys Glu Phe Cys Cys Asn HyPro Ala Cys 4MeO-Phe Gly Cys Tyr
SEQ ID NO: 1901  Cys Cys Glu Phe Cys Cys Asn HyPro Ala Cys 4NO2-Phe Gly Cys Tyr
SEQ ID NO: 1902  Cys Cys Glu Phe Cys Cys Asn HyPro Ala Cys 5F-Phe Gly Cys Tyr
SEQ ID NO: 1903  Cys Cys Glu Phe Cys Cys Asn HyPro Ala Cys 4MeF3-Phe Gly Cys Tyr
SEQ ID NO: 1904  Cys Cys Glu Phe Cys Cys Asn Pip Ala Cys Thr Gly Cys Tyr
SEQ ID NO: 1905  Cys Cys Glu Phe Cys Cys Asn Pip Ala Cys Ser Gly Cys Tyr
SEQ ID NO: 1906  Cys Cys Glu Phe Cys Cys Asn Pip Ala Cys 4F-Phe Gly Cys Tyr
SEQ ID NO: 1907  Cys Cys Glu Phe Cys Cys Asn Pip Ala Cys 4MeO-Phe Gly Cys Tyr
SEQ ID NO: 1908  Cys Cys Glu Phe Cys Cys Asn Pip Ala Cys 4NO2-Phe Gly Cys Tyr
SEQ ID NO: 1909  Cys Cys Glu Phe Cys Cys Asn Pip Ala Cys 5F-Phe Gly Cys Tyr
SEQ ID NO: 1910  Cys Cys Glu Phe Cys Cys Asn Pip Ala Cys 4MeF3-Phe Gly Cys Tyr
SEQ ID NO: 1911  Cys Cys Glu Phe Cys Cys Asn Ile Ala Cys Thr Gly Cys Tyr
SEQ ID NO: 1912  Cys Cys Glu Phe Cys Cys Asn Ile Ala Cys Ser Gly Cys Tyr
SEQ ID NO: 1913  Cys Cys Glu Phe Cys Cys Asn Ile Ala Cys 4F-Phe Gly Cys Tyr
SEQ ID NO: 1914  Cys Cys Glu Phe Cys Cys Asn Ile Ala Cys 4MeO-Phe Gly Cys Tyr
SEQ ID NO: 1915  Cys Cys Glu Phe Cys Cys Asn Ile Ala Cys 4NO2-Phe Gly Cys Tyr
SEQ ID NO: 1916  Cys Cys Glu Phe Cys Cys Asn Ile Ala Cys 5F-Phe Gly Cys Tyr
SEQ ID NO: 1917  Cys Cys Glu Phe Cys Cys Asn Ile Ala Cys 4MeF3-Phe Gly Cys Tyr
SEQ ID NO: 1918  Cys Cys Glu Phe Cys Cys Asn Ala Ala Cys Thr Gly Cys Tyr
SEQ ID NO: 1919  Cys Cys Glu Phe Cys Cys Asn Ala Ala Cys Ser Gly Cys Tyr
SEQ ID NO: 1920  Cys Cys Glu Phe Cys Cys Asn Ala Ala Cys 4F-Phe Gly Cys Tyr
SEQ ID NO: 1921  Cys Cys Glu Phe Cys Cys Asn Ala Ala Cys 4MeO-Phe Gly Cys Tyr
SEQ ID NO: 1922  Cys Cys Glu Phe Cys Cys Asn Ala Ala Cys 4NO2-Phe Gly Cys Tyr
SEQ ID NO: 1923  Cys Cys Glu Phe Cys Cys Asn Ala Ala Cys 5F-Phe Gly Cys Tyr
SEQ ID NO: 1924  Cys Cys Glu Phe Cys Cys Asn Ala Ala Cys 4MeF3-Phe Gly Cys Tyr
SEQ ID NO: 1925  Cys Cys Glu Phe Cys Cys Asn Dhp Ala Cys Ala D-Ala Cys Tyr
SEQ ID NO: 1926  Cys Cys Glu Phe Cys Cys Asn Thz Ala Cys Ala D-Ala Cys Tyr
SEQ ID NO: 1927  Cys Cys Glu Phe Cys Cys Asn HyPro Ala Cys Ala D-Ala Cys Tyr
SEQ ID NO: 1928  Cys Cys Glu Phe Cys Cys Asn Pip Ala Cys Ala D-Ala Cys Tyr
SEQ ID NO: 1929  Cys Cys Glu Phe Cys Cys Asn Ile Ala Cys Ala D-Ala Cys Tyr
SEQ ID NO: 1930  Cys Cys Glu Phe Cys Cys Asn Ala Ala Cys Ala D-Ala Cys Tyr
SEQ ID NO: 1931  Cys Cys Glu Phe Cys Cys Asn Dhp Ala Cys Ala Gly Cys Ile
SEQ ID NO: 1932  Cys Cys Glu Phe Cys Cys Asn Thz Ala Cys Ala Gly Cys Ile

TABLE 3C-continued

Triple substitutions from Scheme 1

SEQ ID NO: 1933  Cys Cys Glu Phe Cys Cys Asn HyPro Ala Cys Ala Gly Cys Ile
SEQ ID NO: 1934  Cys Cys Glu Phe Cys Cys Asn Pip Ala Cys Ala Gly Cys Ile
SEQ ID NO: 1935  Cys Cys Glu Phe Cys Cys Asn Ile Ala Cys Ala Gly Cys Ile
SEQ ID NO: 1936  Cys Cys Glu Phe Cys Cys Asn Ala Ala Cys Ala Gly Cys Ile
SEQ ID NO: 1937  Cys Cys Glu Phe Cys Cys Asn Dhp Ala Cys Ala Gly Cys Trp
SEQ ID NO: 1938  Cys Cys Glu Phe Cys Cys Asn Thz Ala Cys Ala Gly Cys Trp
SEQ ID NO: 1939  Cys Cys Glu Phe Cys Cys Asn HyPro Ala Cys Ala Gly Cys Trp
SEQ ID NO: 1940  Cys Cys Glu Phe Cys Cys Asn Pip Ala Cys Ala Gly Cys Trp
SEQ ID NO: 1941  Cys Cys Glu Phe Cys Cys Asn Ile Ala Cys Ala Gly Cys Trp
SEQ ID NO: 1942  Cys Cys Glu Phe Cys Cys Asn Ala Ala Cys Ala Gly Cys Trp
SEQ ID NO: 1943  Cys Cys Glu Tyr Cys Cys Asn Dhp Ala Cys Thr Gly Cys Tyr
SEQ ID NO: 1944  Cys Cys Glu Tyr Cys Cys Asn Dhp Ala Cys Ser Gly Cys Tyr
SEQ ID NO: 1945  Cys Cys Glu Tyr Cys Cys Asn Dhp Ala Cys 4F-Phe Gly Cys Tyr
SEQ ID NO: 1946  Cys Cys Glu Tyr Cys Cys Asn Dhp Ala Cys 4MeO-Phe Gly Cys Tyr
SEQ ID NO: 1947  Cys Cys Glu Tyr Cys Cys Asn Dhp Ala Cys 4NO2-Phe Gly Cys Tyr
SEQ ID NO: 1948  Cys Cys Glu Tyr Cys Cys Asn Dhp Ala Cys 5F-Phe Gly Cys Tyr
SEQ ID NO: 1949  Cys Cys Glu Tyr Cys Cys Asn Dhp Ala Cys 4MeF3-Phe Gly Cys Tyr
SEQ ID NO: 1950  Cys Cys Glu Tyr Cys Cys Asn Thz Ala Cys Thr Gly Cys Tyr
SEQ ID NO: 1951  Cys Cys Glu Tyr Cys Cys Asn Thz Ala Cys Ser Gly Cys Tyr
SEQ ID NO: 1952  Cys Cys Glu Tyr Cys Cys Asn Thz Ala Cys 4F-Phe Gly Cys Tyr
SEQ ID NO: 1953  Cys Cys Glu Tyr Cys Cys Asn Thz Ala Cys 4MeO-Phe Gly Cys Tyr
SEQ ID NO: 1954  Cys Cys Glu Tyr Cys Cys Asn Thz Ala Cys 4NO2-Phe Gly Cys Tyr
SEQ ID NO: 1955  Cys Cys Glu Tyr Cys Cys Asn Thz Ala Cys 5F-Phe Gly Cys Tyr
SEQ ID NO: 1956  Cys Cys Glu Tyr Cys Cys Asn Thz Ala Cys 4MeF3-Phe Gly Cys Tyr
SEQ ID NO: 1957  Cys Cys Glu Tyr Cys Cys Asn HyPro Ala Cys Thr Gly Cys Tyr
SEQ ID NO: 1958  Cys Cys Glu Tyr Cys Cys Asn HyPro Ala Cys Ser Gly Cys Tyr
SEQ ID NO: 1959  Cys Cys Glu Tyr Cys Cys Asn HyPro Ala Cys 4F-Phe Gly Cys Tyr
SEQ ID NO: 1960  Cys Cys Glu Tyr Cys Cys Asn HyPro Ala Cys 4MeO-Phe Gly Cys Tyr
SEQ ID NO: 1961  Cys Cys Glu Tyr Cys Cys Asn HyPro Ala Cys 4NO2-Phe Gly Cys Tyr
SEQ ID NO: 1962  Cys Cys Glu Tyr Cys Cys Asn HyPro Ala Cys 5F-Phe Gly Cys Tyr
SEQ ID NO: 1963  Cys Cys Glu Tyr Cys Cys Asn HyPro Ala Cys 4MeF3-Phe Gly Cys Tyr
SEQ ID NO: 1964  Cys Cys Glu Tyr Cys Cys Asn Pip Ala Cys Thr Gly Cys Tyr
SEQ ID NO: 1965  Cys Cys Glu Tyr Cys Cys Asn Pip Ala Cys Ser Gly Cys Tyr
SEQ ID NO: 1966  Cys Cys Glu Tyr Cys Cys Asn Pip Ala Cys 4F-Phe Gly Cys Tyr
SEQ ID NO: 1967  Cys Cys Glu Tyr Cys Cys Asn Pip Ala Cys 4MeO-Phe Gly Cys Tyr
SEQ ID NO: 1968  Cys Cys Glu Tyr Cys Cys Asn Pip Ala Cys 4NO2-Phe Gly Cys Tyr
SEQ ID NO: 1969  Cys Cys Glu Tyr Cys Cys Asn Pip Ala Cys 5F-Phe Gly Cys Tyr
SEQ ID NO: 1970  Cys Cys Glu Tyr Cys Cys Asn Pip Ala Cys 4MeF3-Phe Gly Cys Tyr
SEQ ID NO: 1971  Cys Cys Glu Tyr Cys Cys Asn Ile Ala Cys Thr Gly Cys Tyr

TABLE 3C-continued

Triple substitutions from Scheme 1

| SEQ ID NO: 1972 | Cys Cys Glu Tyr Cys Cys Asn Ile Ala Cys Ser Gly Cys Tyr |
| SEQ ID NO: 1973 | Cys Cys Glu Tyr Cys Cys Asn Ile Ala Cys 4F-Phe Gly Cys Tyr |
| SEQ ID NO: 1974 | Cys Cys Glu Tyr Cys Cys Asn Ile Ala Cys 4MeO-Phe Gly Cys Tyr |
| SEQ ID NO: 1975 | Cys Cys Glu Tyr Cys Cys Asn Ile Ala Cys 4NO2-Phe Gly Cys Tyr |
| SEQ ID NO: 1976 | Cys Cys Glu Tyr Cys Cys Asn Ile Ala Cys 5F-Phe Gly Cys Tyr |
| SEQ ID NO: 1977 | Cys Cys Glu Tyr Cys Cys Asn Ile Ala Cys 4MeF3-Phe Gly Cys Tyr |
| SEQ ID NO: 1978 | Cys Cys Glu Tyr Cys Cys Asn Ala Ala Cys Thr Gly Cys Tyr |
| SEQ ID NO: 1979 | Cys Cys Glu Tyr Cys Cys Asn Ala Ala Cys Ser Gly Cys Tyr |
| SEQ ID NO: 1980 | Cys Cys Glu Tyr Cys Cys Asn Ala Ala Cys 4F-Phe Gly Cys Tyr |
| SEQ ID NO: 1981 | Cys Cys Glu Tyr Cys Cys Asn Ala Ala Cys 4MeO-Phe Gly Cys Tyr |
| SEQ ID NO: 1982 | Cys Cys Glu Tyr Cys Cys Asn Ala Ala Cys 4NO2-Phe Gly Cys Tyr |
| SEQ ID NO: 1983 | Cys Cys Glu Tyr Cys Cys Asn Ala Ala Cys 5F-Phe Gly Cys Tyr |
| SEQ ID NO: 1984 | Cys Cys Glu Tyr Cys Cys Asn Ala Ala Cys 4MeF3-Phe Gly Cys Tyr |
| SEQ ID NO: 1985 | Cys Cys Glu Tyr Cys Cys Asn Dhp Ala Cys Ala D-Ala Cys Tyr |
| SEQ ID NO: 1986 | Cys Cys Glu Tyr Cys Cys Asn Thz Ala Cys Ala D-Ala Cys Tyr |
| SEQ ID NO: 1987 | Cys Cys Glu Tyr Cys Cys Asn HyPro Ala Cys Ala D-Ala Cys Tyr |
| SEQ ID NO: 1988 | Cys Cys Glu Tyr Cys Cys Asn Pip Ala Cys Ala D-Ala Cys Tyr |
| SEQ ID NO: 1989 | Cys Cys Glu Tyr Cys Cys Asn Ile Ala Cys Ala D-Ala Cys Tyr |
| SEQ ID NO: 1990 | Cys Cys Glu Tyr Cys Cys Asn Ala Ala Cys Ala D-Ala Cys Tyr |
| SEQ ID NO: 1991 | Cys Cys Glu Tyr Cys Cys Asn Dhp Ala Cys Ala Gly Cys Ile |
| SEQ ID NO: 1992 | Cys Cys Glu Tyr Cys Cys Asn Thz Ala Cys Ala Gly Cys Ile |
| SEQ ID NO: 1993 | Cys Cys Glu Tyr Cys Cys Asn HyPro Ala Cys Ala Gly Cys Ile |
| SEQ ID NO: 1994 | Cys Cys Glu Tyr Cys Cys Asn Pip Ala Cys Ala Gly Cys Ile |
| SEQ ID NO: 1995 | Cys Cys Glu Tyr Cys Cys Asn Ile Ala Cys Ala Gly Cys Ile |
| SEQ ID NO: 1996 | Cys Cys Glu Tyr Cys Cys Asn Ala Ala Cys Ala Gly Cys Ile |
| SEQ ID NO: 1997 | Cys Cys Glu Tyr Cys Cys Asn Dhp Ala Cys Ala Gly Cys Trp |
| SEQ ID NO: 1998 | Cys Cys Glu Tyr Cys Cys Asn Thz Ala Cys Ala Gly Cys Trp |
| SEQ ID NO: 1999 | Cys Cys Glu Tyr Cys Cys Asn HyPro Ala Cys Ala Gly Cys Trp |
| SEQ ID NO: 2000 | Cys Cys Glu Tyr Cys Cys Asn Pip Ala Cys Ala Gly Cys Trp |
| SEQ ID NO: 2001 | Cys Cys Glu Tyr Cys Cys Asn Ile Ala Cys Ala Gly Cys Trp |
| SEQ ID NO: 2002 | Cys Cys Glu Tyr Cys Cys Asn Ala Ala Cys Ala Gly Cys Trp |
| SEQ ID NO: 2003 | Cys Cys Glu Dopa Cys Cys Asn Dhp Ala Cys Thr Gly Cys Tyr |
| SEQ ID NO: 2004 | Cys Cys Glu Dopa Cys Cys Asn Dhp Ala Cys Ser Gly Cys Tyr |
| SEQ ID NO: 2005 | Cys Cys Glu Dopa Cys Cys Asn Dhp Ala Cys 4F-Phe Gly Cys Tyr |
| SEQ ID NO: 2006 | Cys Cys Glu Dopa Cys Cys Asn Dhp Ala Cys 4MeO-Phe Gly Cys Tyr |
| SEQ ID NO: 2007 | Cys Cys Glu Dopa Cys Cys Asn Dhp Ala Cys 4NO2-Phe Gly Cys Tyr |
| SEQ ID NO: 2008 | Cys Cys Glu Dopa Cys Cys Asn Dhp Ala Cys 5F-Phe Gly Cys Tyr |
| SEQ ID NO: 2009 | Cys Cys Glu Dopa Cys Cys Asn Dhp Ala Cys 4MeF3-Phe Gly Cys Tyr |
| SEQ ID NO: 2010 | Cys Cys Glu Dopa Cys Cys Asn Thz Ala Cys Thr Gly Cys Tyr |

TABLE 3C-continued

Triple substitutions from Scheme 1

SEQ ID NO: 2011  Cys Cys Glu Dopa Cys Cys Asn Thz Ala Cys Ser Gly Cys Tyr
SEQ ID NO: 2012  Cys Cys Glu Dopa Cys Cys Asn Thz Ala Cys 4F-Phe Gly Cys Tyr
SEQ ID NO: 2013  Cys Cys Glu Dopa Cys Cys Asn Thz Ala Cys 4MeO-Phe Gly Cys Tyr
SEQ ID NO: 2014  Cys Cys Glu Dopa Cys Cys Asn Thz Ala Cys 4NO2-Phe Gly Cys Tyr
SEQ ID NO: 2015  Cys Cys Glu Dopa Cys Cys Asn Thz Ala Cys 5F-Phe Gly Cys Tyr
SEQ ID NO: 2016  Cys Cys Glu Dopa Cys Cys Asn Thz Ala Cys 4MeF3-Phe Gly Cys Tyr
SEQ ID NO: 2017  Cys Cys Glu Dopa Cys Cys Asn HyPro Ala Cys Thr Gly Cys Tyr
SEQ ID NO: 2018  Cys Cys Glu Dopa Cys Cys Asn HyPro Ala Cys Ser Gly Cys Tyr
SEQ ID NO: 2019  Cys Cys Glu Dopa Cys Cys Asn HyPro Ala Cys 4F-Phe Gly Cys Tyr
SEQ ID NO: 2020  Cys Cys Glu Dopa Cys Cys Asn HyPro Ala Cys 4MeO-Phe Gly Cys Tyr
SEQ ID NO: 2021  Cys Cys Glu Dopa Cys Cys Asn HyPro Ala Cys 4NO2-Phe Gly Cys Tyr
SEQ ID NO: 2022  Cys Cys Glu Dopa Cys Cys Asn HyPro Ala Cys 5F-Phe Gly Cys Tyr
SEQ ID NO: 2023  Cys Cys Glu Dopa Cys Cys Asn HyPro Ala Cys 4MeF3-Phe Gly Cys Tyr
SEQ ID NO: 2024  Cys Cys Glu Dopa Cys Cys Asn Pip Ala Cys Thr Gly Cys Tyr
SEQ ID NO: 2025  Cys Cys Glu Dopa Cys Cys Asn Pip Ala Cys Ser Gly Cys Tyr
SEQ ID NO: 2026  Cys Cys Glu Dopa Cys Cys Asn Pip Ala Cys 4F-Phe Gly Cys Tyr
SEQ ID NO: 2027  Cys Cys Glu Dopa Cys Cys Asn Pip Ala Cys 4MeO-Phe Gly Cys Tyr
SEQ ID NO: 2028  Cys Cys Glu Dopa Cys Cys Asn Pip Ala Cys 4NO2-Phe Gly Cys Tyr
SEQ ID NO: 2029  Cys Cys Glu Dopa Cys Cys Asn Pip Ala Cys 5F-Phe Gly Cys Tyr
SEQ ID NO: 2030  Cys Cys Glu Dopa Cys Cys Asn Pip Ala Cys 4MeF3-Phe Gly Cys Tyr
SEQ ID NO: 2031  Cys Cys Glu Dopa Cys Cys Asn Ile Ala Cys Thr Gly Cys Tyr
SEQ ID NO: 2032  Cys Cys Glu Dopa Cys Cys Asn Ile Ala Cys Ser Gly Cys Tyr
SEQ ID NO: 2033  Cys Cys Glu Dopa Cys Cys Asn Ile Ala Cys 4F-Phe Gly Cys Tyr
SEQ ID NO: 2034  Cys Cys Glu Dopa Cys Cys Asn Ile Ala Cys 4MeO-Phe Gly Cys Tyr
SEQ ID NO: 2035  Cys Cys Glu Dopa Cys Cys Asn Ile Ala Cys 4NO2-Phe Gly Cys Tyr
SEQ ID NO: 2036  Cys Cys Glu Dopa Cys Cys Asn Ile Ala Cys 5F-Phe Gly Cys Tyr
SEQ ID NO: 2037  Cys Cys Glu Dopa Cys Cys Asn Ile Ala Cys 4MeF3-Phe Gly Cys Tyr
SEQ ID NO: 2038  Cys Cys Glu Dopa Cys Cys Asn Ala Ala Cys Thr Gly Cys Tyr
SEQ ID NO: 2039  Cys Cys Glu Dopa Cys Cys Asn Ala Ala Cys Ser Gly Cys Tyr
SEQ ID NO: 2040  Cys Cys Glu Dopa Cys Cys Asn Ala Ala Cys 4F-Phe Gly Cys Tyr
SEQ ID NO: 2041  Cys Cys Glu Dopa Cys Cys Asn Ala Ala Cys 4MeO-Phe Gly Cys Tyr
SEQ ID NO: 2042  Cys Cys Glu Dopa Cys Cys Asn Ala Ala Cys 4NO2-Phe Gly Cys Tyr
SEQ ID NO: 2043  Cys Cys Glu Dopa Cys Cys Asn Ala Ala Cys 5F-Phe Gly Cys Tyr
SEQ ID NO: 2044  Cys Cys Glu Dopa Cys Cys Asn Ala Ala Cys 4MeF3-Phe Gly Cys Tyr
SEQ ID NO: 2045  Cys Cys Glu Dopa Cys Cys Asn Dhp Ala Cys Ala D-Ala Cys Tyr
SEQ ID NO: 2046  Cys Cys Glu Dopa Cys Cys Asn Thz Ala Cys Ala D-Ala Cys Tyr
SEQ ID NO: 2047  Cys Cys Glu Dopa Cys Cys Asn HyPro Ala Cys Ala D-Ala Cys Tyr
SEQ ID NO: 2048  Cys Cys Glu Dopa Cys Cys Asn Pip Ala Cys Ala D-Ala Cys Tyr
SEQ ID NO: 2049  Cys Cys Glu Dopa Cys Cys Asn Ile Ala Cys Ala D-Ala Cys Tyr TABLE 3C-continued Triple substitutions from Scheme 1

| SEQ ID NO: | Sequence |
|---|---|
| 2050 | Cys Cys Glu Dopa Cys Cys Asn Ala Ala Cys Ala D-Ala Cys Tyr |
| 2051 | Cys Cys Glu Dopa Cys Cys Asn Dhp Ala Cys Ala Gly Cys Ile |
| 2052 | Cys Cys Glu Dopa Cys Cys Asn Thz Ala Cys Ala Gly Cys Ile |
| 2053 | Cys Cys Glu Dopa Cys Cys Asn HyPro Ala Cys Ala Gly Cys Ile |
| 2054 | Cys Cys Glu Dopa Cys Cys Asn Pip Ala Cys Ala Gly Cys Ile |
| 2055 | Cys Cys Glu Dopa Cys Cys Asn Ile Ala Cys Ala Gly Cys Ile |
| 2056 | Cys Cys Glu Dopa Cys Cys Asn Ala Ala Cys Ala Gly Cys Ile |
| 2057 | Cys Cys Glu Dopa Cys Cys Asn Dhp Ala Cys Ala Gly Cys Trp |
| 2058 | Cys Cys Glu Dopa Cys Cys Asn Thz Ala Cys Ala Gly Cys Trp |
| 2059 | Cys Cys Glu Dopa Cys Cys Asn HyPro Ala Cys Ala Gly Cys Trp |
| 2060 | Cys Cys Glu Dopa Cys Cys Asn Pip Ala Cys Ala Gly Cys Trp |
| 2061 | Cys Cys Glu Dopa Cys Cys Asn Ile Ala Cys Ala Gly Cys Trp |
| 2062 | Cys Cys Glu Dopa Cys Cys Asn Ala Ala Cys Ala Gly Cys Trp |
| 2063 | Cys Cys Glu NMe-Leu Cys Cys Asn Dhp Ala Cys Thr Gly Cys Tyr |
| 2064 | Cys Cys Glu NMe-Leu Cys Cys Asn Dhp Ala Cys Ser Gly Cys Tyr |
| 2065 | Cys Cys Glu NMe-Leu Cys Cys Asn Dhp Ala Cys 4F-Phe Gly Cys Tyr |
| 2066 | Cys Cys Glu NMe-Leu Cys Cys Asn Dhp Ala Cys 4MeO-Phe Gly Cys Tyr |
| 2067 | Cys Cys Glu NMe-Leu Cys Cys Asn Dhp Ala Cys 4NO2-Phe Gly Cys Tyr |
| 2068 | Cys Cys Glu NMe-Leu Cys Cys Asn Dhp Ala Cys 5F-Phe Gly Cys Tyr |
| 2069 | Cys Cys Glu NMe-Leu Cys Cys Asn Dhp Ala Cys 4MeF3-Phe Gly Cys Tyr |
| 2070 | Cys Cys Glu NMe-Leu Cys Cys Asn Thz Ala Cys Thr Gly Cys Tyr |
| 2071 | Cys Cys Glu NMe-Leu Cys Cys Asn Thz Ala Cys Ser Gly Cys Tyr |
| 2072 | Cys Cys Glu NMe-Leu Cys Cys Asn Thz Ala Cys 4F-Phe Gly Cys Tyr |
| 2073 | Cys Cys Glu NMe-Leu Cys Cys Asn Thz Ala Cys 4MeO-Phe Gly Cys Tyr |
| 2074 | Cys Cys Glu NMe-Leu Cys Cys Asn Thz Ala Cys 4NO2-Phe Gly Cys Tyr |
| 2075 | Cys Cys Glu NMe-Leu Cys Cys Asn Thz Ala Cys 5F-Phe Gly Cys Tyr |
| 2076 | Cys Cys Glu NMe-Leu Cys Cys Asn Thz Ala Cys 4MeF3-Phe Gly Cys Tyr |
| 2077 | Cys Cys Glu NMe-Leu Cys Cys Asn HyPro Ala Cys Thr Gly Cys Tyr |
| 2078 | Cys Cys Glu NMe-Leu Cys Cys Asn HyPro Ala Cys Ser Gly Cys Tyr |
| 2079 | Cys Cys Glu NMe-Leu Cys Cys Asn HyPro Ala Cys 4F-Phe Gly Cys Tyr |
| 2080 | Cys Cys Glu NMe-Leu Cys Cys Asn HyPro Ala Cys 4MeO-Phe Gly Cys Tyr |
| 2081 | Cys Cys Glu NMe-Leu Cys Cys Asn HyPro Ala Cys 4NO2-Phe Gly Cys Tyr |
| 2082 | Cys Cys Glu NMe-Leu Cys Cys Asn HyPro Ala Cys 5F-Phe Gly Cys Tyr |
| 2083 | Cys Cys Glu NMe-Leu Cys Cys Asn HyPro Ala Cys 4MeF3-Phe Gly Cys Tyr |
| 2084 | Cys Cys Glu NMe-Leu Cys Cys Asn Pip Ala Cys Thr Gly Cys Tyr |
| 2085 | Cys Cys Glu NMe-Leu Cys Cys Asn Pip Ala Cys Ser Gly Cys Tyr |
| 2086 | Cys Cys Glu NMe-Leu Cys Cys Asn Pip Ala Cys 4F-Phe Gly Cys Tyr |
| 2087 | Cys Cys Glu NMe-Leu Cys Cys Asn Pip Ala Cys 4MeO-Phe Gly Cys Tyr |
| 2088 | Cys Cys Glu NMe-Leu Cys Cys Asn Pip Ala Cys 4NO2-Phe Gly Cys Tyr |

TABLE 3C-continued

Triple substitutions from Scheme 1

```
SEQ ID NO: 2089  Cys Cys Glu NMe-Leu Cys Cys Asn Pip Ala Cys 5F-Phe Gly Cys Tyr
SEQ ID NO: 2090  Cys Cys Glu NMe-Leu Cys Cys Asn Pip Ala Cys 4MeF3-Phe Gly Cys Tyr
SEQ ID NO: 2091  Cys Cys Glu NMe-Leu Cys Cys Asn Ile Ala Cys Thr Gly Cys Tyr
SEQ ID NO: 2092  Cys Cys Glu NMe-Leu Cys Cys Asn Ile Ala Cys Ser Gly Cys Tyr
SEQ ID NO: 2093  Cys Cys Glu NMe-Leu Cys Cys Asn Ile Ala Cys 4F-Phe Gly Cys Tyr
SEQ ID NO: 2094  Cys Cys Glu NMe-Leu Cys Cys Asn Ile Ala Cys 4MeO-Phe Gly Cys Tyr
SEQ ID NO: 2095  Cys Cys Glu NMe-Leu Cys Cys Asn Ile Ala Cys 4NO2-Phe Gly Cys Tyr
SEQ ID NO: 2096  Cys Cys Glu NMe-Leu Cys Cys Asn Ile Ala Cys 5F-Phe Gly Cys Tyr
SEQ ID NO: 2097  Cys Cys Glu NMe-Leu Cys Cys Asn Ile Ala Cys 4MeF3-Phe Gly Cys Tyr
SEQ ID NO: 2098  Cys Cys Glu NMe-Leu Cys Cys Asn Ala Ala Cys Thr Gly Cys Tyr
SEQ ID NO: 2099  Cys Cys Glu NMe-Leu Cys Cys Asn Ala Ala Cys Ser Gly Cys Tyr
SEQ ID NO: 2100  Cys Cys Glu NMe-Leu Cys Cys Asn Ala Ala Cys 4F-Phe Gly Cys Tyr
SEQ ID NO: 2101  Cys Cys Glu NMe-Leu Cys Cys Asn Ala Ala Cys 4MeO-Phe Gly Cys Tyr
SEQ ID NO: 2102  Cys Cys Glu NMe-Leu Cys Cys Asn Ala Ala Cys 4NO2-Phe Gly Cys Tyr
SEQ ID NO: 2103  Cys Cys Glu NMe-Leu Cys Cys Asn Ala Ala Cys 5F-Phe Gly Cys Tyr
SEQ ID NO: 2104  Cys Cys Glu NMe-Leu Cys Cys Asn Ala Ala Cys 4MeF3-Phe Gly Cys Tyr
SEQ ID NO: 2105  Cys Cys Glu NMe-Leu Cys Cys Asn Dhp Ala Cys Ala D-Ala Cys Tyr
SEQ ID NO: 2106  Cys Cys Glu NMe-Leu Cys Cys Asn Thz Ala Cys Ala D-Ala Cys Tyr
SEQ ID NO: 2107  Cys Cys Glu NMe-Leu Cys Cys Asn HyPro Ala Cys Ala D-Ala Cys Tyr
SEQ ID NO: 2108  Cys Cys Glu NMe-Leu Cys Cys Asn Pip Ala Cys Ala D-Ala Cys Tyr
SEQ ID NO: 2109  Cys Cys Glu NMe-Leu Cys Cys Asn Ile Ala Cys Ala D-Ala Cys Tyr
SEQ ID NO: 2110  Cys Cys Glu NMe-Leu Cys Cys Asn Ala Ala Cys Ala D-Ala Cys Tyr
SEQ ID NO: 2111  Cys Cys Glu NMe-Leu Cys Cys Asn Dhp Ala Cys Ala Gly Cys Ile
SEQ ID NO: 2112  Cys Cys Glu NMe-Leu Cys Cys Asn Thz Ala Cys Ala Gly Cys Ile
SEQ ID NO: 2113  Cys Cys Glu NMe-Leu Cys Cys Asn HyPro Ala Cys Ala Gly Cys Ile
SEQ ID NO: 2114  Cys Cys Glu NMe-Leu Cys Cys Asn Pip Ala Cys Ala Gly Cys Ile
SEQ ID NO: 2115  Cys Cys Glu NMe-Leu Cys Cys Asn Ile Ala Cys Ala Gly Cys Ile
SEQ ID NO: 2116  Cys Cys Glu NMe-Leu Cys Cys Asn Ala Ala Cys Ala Gly Cys Ile
SEQ ID NO: 2117  Cys Cys Glu NMe-Leu Cys Cys Asn Dhp Ala Cys Ala Gly Cys Trp
SEQ ID NO: 2118  Cys Cys Glu NMe-Leu Cys Cys Asn Thz Ala Cys Ala Gly Cys Trp
SEQ ID NO: 2119  Cys Cys Glu NMe-Leu Cys Cys Asn HyPro Ala Cys Ala Gly Cys Trp
SEQ ID NO: 2120  Cys Cys Glu NMe-Leu Cys Cys Asn Pip Ala Cys Ala Gly Cys Trp
SEQ ID NO: 2121  Cys Cys Glu NMe-Leu Cys Cys Asn Ile Ala Cys Ala Gly Cys Trp
SEQ ID NO: 2122  Cys Cys Glu NMe-Leu Cys Cys Asn Ala Ala Cys Ala Gly Cys Trp
SEQ ID NO: 2123  Cys Cys Glu Thr Cys Cys Asn Pro Ala Cys Thr D-Ala Cys Tyr
SEQ ID NO: 2124  Cys Cys Glu Thr Cys Cys Asn Pro Ala Cys Ser D-Ala Cys Tyr
SEQ ID NO: 2125  Cys Cys Glu Thr Cys Cys Asn Pro Ala Cys 4F-Phe D-Ala Cys Tyr
SEQ ID NO: 2126  Cys Cys Glu Thr Cys Cys Asn Pro Ala Cys 4MeO-Phe D-Ala Cys Tyr
SEQ ID NO: 2127  Cys Cys Glu Thr Cys Cys Asn Pro Ala Cys 4NO2-Phe D-Ala Cys Tyr
```

TABLE 3C-continued

Triple substitutions from Scheme 1

```
SEQ ID NO: 2128  Cys Cys Glu Thr    Cys Cys Asn Pro Ala Cys 5F-Phe    D-Ala Cys Tyr
SEQ ID NO: 2129  Cys Cys Glu Thr    Cys Cys Asn Pro Ala Cys 4MeF3-Phe D-Ala Cys Tyr
SEQ ID NO: 2130  Cys Cys Glu Thr    Cys Cys Asn Pro Ala Cys Thr       Gly   Cys Ile
SEQ ID NO: 2131  Cys Cys Glu Thr    Cys Cys Asn Pro Ala Cys Ser       Gly   Cys Ile
SEQ ID NO: 2132  Cys Cys Glu Thr    Cys Cys Asn Pro Ala Cys 4F-Phe    Gly   Cys Ile
SEQ ID NO: 2133  Cys Cys Glu Thr    Cys Cys Asn Pro Ala Cys 4MeO-Phe  Gly   Cys Ile
SEQ ID NO: 2134  Cys Cys Glu Thr    Cys Cys Asn Pro Ala Cys 4NO2-Phe  Gly   Cys Ile
SEQ ID NO: 2135  Cys Cys Glu Thr    Cys Cys Asn Pro Ala Cys 5F-Phe    Gly   Cys Ile
SEQ ID NO: 2136  Cys Cys Glu Thr    Cys Cys Asn Pro Ala Cys 4MeF3-Phe Gly   Cys Ile
SEQ ID NO: 2137  Cys Cys Glu Thr    Cys Cys Asn Pro Ala Cys Thr       Gly   Cys Trp
SEQ ID NO: 2138  Cys Cys Glu Thr    Cys Cys Asn Pro Ala Cys Ser       Gly   Cys Trp
SEQ ID NO: 2139  Cys Cys Glu Thr    Cys Cys Asn Pro Ala Cys 4F-Phe    Gly   Cys Trp
SEQ ID NO: 2140  Cys Cys Glu Thr    Cys Cys Asn Pro Ala Cys 4MeO-Phe  Gly   Cys Trp
SEQ ID NO: 2141  Cys Cys Glu Thr    Cys Cys Asn Pro Ala Cys 4NO2-Phe  Gly   Cys Trp
SEQ ID NO: 2142  Cys Cys Glu Thr    Cys Cys Asn Pro Ala Cys 5F-Phe    Gly   Cys Trp
SEQ ID NO: 2143  Cys Cys Glu Thr    Cys Cys Asn Pro Ala Cys 4MeF3-Phe Gly   Cys Trp
SEQ ID NO: 2144  Cys Cys Glu hLeu   Cys Cys Asn Pro Ala Cys Thr       D-Ala Cys Tyr
SEQ ID NO: 2145  Cys Cys Glu hLeu   Cys Cys Asn Pro Ala Cys Ser       D-Ala Cys Tyr
SEQ ID NO: 2146  Cys Cys Glu hLeu   Cys Cys Asn Pro Ala Cys 4F-Phe    D-Ala Cys Tyr
SEQ ID NO: 2147  Cys Cys Glu hLeu   Cys Cys Asn Pro Ala Cys 4MeO-Phe  D-Ala Cys Tyr
SEQ ID NO: 2148  Cys Cys Glu hLeu   Cys Cys Asn Pro Ala Cys 4NO2-Phe  D-Ala Cys Tyr
SEQ ID NO: 2149  Cys Cys Glu hLeu   Cys Cys Asn Pro Ala Cys 5F-Phe    D-Ala Cys Tyr
SEQ ID NO: 2150  Cys Cys Glu hLeu   Cys Cys Asn Pro Ala Cys 4MeF3-Phe D-Ala Cys Tyr
SEQ ID NO: 2151  Cys Cys Glu hLeu   Cys Cys Asn Pro Ala Cys Thr       Gly   Cys Ile
SEQ ID NO: 2152  Cys Cys Glu hLeu   Cys Cys Asn Pro Ala Cys Ser       Gly   Cys Ile
SEQ ID NO: 2153  Cys Cys Glu hLeu   Cys Cys Asn Pro Ala Cys 4F-Phe    Gly   Cys Ile
SEQ ID NO: 2154  Cys Cys Glu hLeu   Cys Cys Asn Pro Ala Cys 4MeO-Phe  Gly   Cys Ile
SEQ ID NO: 2155  Cys Cys Glu hLeu   Cys Cys Asn Pro Ala Cys 4NO2-Phe  Gly   Cys Ile
SEQ ID NO: 2156  Cys Cys Glu hLeu   Cys Cys Asn Pro Ala Cys 5F-Phe    Gly   Cys Ile
SEQ ID NO: 2157  Cys Cys Glu hLeu   Cys Cys Asn Pro Ala Cys 4MeF3-Phe Gly   Cys Ile
SEQ ID NO: 2158  Cys Cys Glu hLeu   Cys Cys Asn Pro Ala Cys Thr       Gly   Cys Trp
SEQ ID NO: 2159  Cys Cys Glu hLeu   Cys Cys Asn Pro Ala Cys Ser       Gly   Cys Trp
SEQ ID NO: 2160  Cys Cys Glu hLeu   Cys Cys Asn Pro Ala Cys 4F-Phe    Gly   Cys Trp
SEQ ID NO: 2161  Cys Cys Glu hLeu   Cys Cys Asn Pro Ala Cys 4MeO-Phe  Gly   Cys Trp
SEQ ID NO: 2162  Cys Cys Glu hLeu   Cys Cys Asn Pro Ala Cys 4NO2-Phe  Gly   Cys Trp
SEQ ID NO: 2163  Cys Cys Glu hLeu   Cys Cys Asn Pro Ala Cys 5F-Phe    Gly   Cys Trp
SEQ ID NO: 2164  Cys Cys Glu hLeu   Cys Cys Asn Pro Ala Cys 4MeF3-Phe Gly   Cys Trp
SEQ ID NO: 2165  Cys Cys Glu norLeu Cys Cys Asn Pro Ala Cys Thr       D-Ala Cys Tyr
SEQ ID NO: 2166  Cys Cys Glu norLeu Cys Cys Asn Pro Ala Cys Ser       D-Ala Cys Tyr
```

TABLE 3C-continued

Triple substitutions from Scheme 1

SEQ ID NO: 2167  Cys Cys Glu norLeu Cys Cys Asn Pro Ala Cys 4F-Phe D-Ala Cys Tyr
SEQ ID NO: 2168  Cys Cys Glu norLeu Cys Cys Asn Pro Ala Cys 4MeO-Phe D-Ala Cys Tyr
SEQ ID NO: 2169  Cys Cys Glu norLeu Cys Cys Asn Pro Ala Cys 4NO2-Phe D-Ala Cys Tyr
SEQ ID NO: 2170  Cys Cys Glu norLeu Cys Cys Asn Pro Ala Cys 5F-Phe D-Ala Cys Tyr
SEQ ID NO: 2171  Cys Cys Glu norLeu Cys Cys Asn Pro Ala Cys 4MeF3-Phe D-Ala Cys Tyr
SEQ ID NO: 2172  Cys Cys Glu norLeu Cys Cys Asn Pro Ala Cys Thr Gly Cys Ile
SEQ ID NO: 2173  Cys Cys Glu norLeu Cys Cys Asn Pro Ala Cys Ser Gly Cys Ile
SEQ ID NO: 2174  Cys Cys Glu norLeu Cys Cys Asn Pro Ala Cys 4F-Phe Gly Cys Ile
SEQ ID NO: 2175  Cys Cys Glu norLeu Cys Cys Asn Pro Ala Cys 4MeO-Phe Gly Cys Ile
SEQ ID NO: 2176  Cys Cys Glu norLeu Cys Cys Asn Pro Ala Cys 4NO2-Phe Gly Cys Ile
SEQ ID NO: 2177  Cys Cys Glu norLeu Cys Cys Asn Pro Ala Cys 5F-Phe Gly Cys Ile
SEQ ID NO: 2178  Cys Cys Glu norLeu Cys Cys Asn Pro Ala Cys 4MeF3-Phe Gly Cys Ile
SEQ ID NO: 2179  Cys Cys Glu norLeu Cys Cys Asn Pro Ala Cys Thr Gly Cys Trp
SEQ ID NO: 2180  Cys Cys Glu norLeu Cys Cys Asn Pro Ala Cys Ser Gly Cys Trp
SEQ ID NO: 2181  Cys Cys Glu norLeu Cys Cys Asn Pro Ala Cys 4F-Phe Gly Cys Trp
SEQ ID NO: 2182  Cys Cys Glu norLeu Cys Cys Asn Pro Ala Cys 4MeO-Phe Gly Cys Trp
SEQ ID NO: 2183  Cys Cys Glu norLeu Cys Cys Asn Pro Ala Cys 4NO2-Phe Gly Cys Trp
SEQ ID NO: 2184  Cys Cys Glu norLeu Cys Cys Asn Pro Ala Cys 5F-Phe Gly Cys Trp
SEQ ID NO: 2185  Cys Cys Glu norLeu Cys Cys Asn Pro Ala Cys 4MeF3-Phe Gly Cys Trp
SEQ ID NO: 2186  Cys Cys Glu ChxAla Cys Cys Asn Pro Ala Cys Thr D-Ala Cys Tyr
SEQ ID NO: 2187  Cys Cys Glu ChxAla Cys Cys Asn Pro Ala Cys Ser D-Ala Cys Tyr
SEQ ID NO: 2188  Cys Cys Glu ChxAla Cys Cys Asn Pro Ala Cys 4F-Phe D-Ala Cys Tyr
SEQ ID NO: 2189  Cys Cys Glu ChxAla Cys Cys Asn Pro Ala Cys 4MeO-Phe D-Ala Cys Tyr
SEQ ID NO: 2190  Cys Cys Glu ChxAla Cys Cys Asn Pro Ala Cys 4NO2-Phe D-Ala Cys Tyr
SEQ ID NO: 2191  Cys Cys Glu ChxAla Cys Cys Asn Pro Ala Cys 5F-Phe D-Ala Cys Tyr
SEQ ID NO: 2192  Cys Cys Glu ChxAla Cys Cys Asn Pro Ala Cys 4MeF3-Phe D-Ala Cys Tyr
SEQ ID NO: 2193  Cys Cys Glu ChxAla Cys Cys Asn Pro Ala Cys Thr Gly Cys Ile
SEQ ID NO: 2194  Cys Cys Glu ChxAla Cys Cys Asn Pro Ala Cys Ser Gly Cys Ile
SEQ ID NO: 2195  Cys Cys Glu ChxAla Cys Cys Asn Pro Ala Cys 4F-Phe Gly Cys Ile
SEQ ID NO: 2196  Cys Cys Glu ChxAla Cys Cys Asn Pro Ala Cys 4MeO-Phe Gly Cys Ile
SEQ ID NO: 2197  Cys Cys Glu ChxAla Cys Cys Asn Pro Ala Cys 4NO2-Phe Gly Cys Ile
SEQ ID NO: 2198  Cys Cys Glu ChxAla Cys Cys Asn Pro Ala Cys 5F-Phe Gly Cys Ile
SEQ ID NO: 2199  Cys Cys Glu ChxAla Cys Cys Asn Pro Ala Cys 4MeF3-Phe Gly Cys Ile
SEQ ID NO: 2200  Cys Cys Glu ChxAla Cys Cys Asn Pro Ala Cys Thr Gly Cys Trp
SEQ ID NO: 2201  Cys Cys Glu ChxAla Cys Cys Asn Pro Ala Cys Ser Gly Cys Trp
SEQ ID NO: 2202  Cys Cys Glu ChxAla Cys Cys Asn Pro Ala Cys 4F-Phe Gly Cys Trp
SEQ ID NO: 2203  Cys Cys Glu ChxAla Cys Cys Asn Pro Ala Cys 4MeO-Phe Gly Cys Trp
SEQ ID NO: 2204  Cys Cys Glu ChxAla Cys Cys Asn Pro Ala Cys 4NO2-Phe Gly Cys Trp
SEQ ID NO: 2205  Cys Cys Glu ChxAla Cys Cys Asn Pro Ala Cys 5F-Phe Gly Cys Trp TABLE 3C-continued

| Triple substitutions from Scheme 1 |
|---|
| SEQ ID NO: 2206 Cys Cys Glu ChxAla Cys Cys Asn Pro Ala Cys 4MeF3-Phe Gly Cys Trp |
| SEQ ID NO: 2207 Cys Cys Glu ChxIle Cys Cys Asn Pro Ala Cys Thr D-Ala Cys Tyr |
| SEQ ID NO: 2208 Cys Cys Glu ChxIle Cys Cys Asn Pro Ala Cys Ser D-Ala Cys Tyr |
| SEQ ID NO: 2209 Cys Cys Glu ChxIle Cys Cys Asn Pro Ala Cys 4F-Phe D-Ala Cys Tyr |
| SEQ ID NO: 2210 Cys Cys Glu ChxIle Cys Cys Asn Pro Ala Cys 4MeO-Phe D-Ala Cys Tyr |
| SEQ ID NO: 2211 Cys Cys Glu ChxIle Cys Cys Asn Pro Ala Cys 4NO2-Phe D-Ala Cys Tyr |
| SEQ ID NO: 2212 Cys Cys Glu ChxIle Cys Cys Asn Pro Ala Cys 5F-Phe D-Ala Cys Tyr |
| SEQ ID NO: 2213 Cys Cys Glu ChxIle Cys Cys Asn Pro Ala Cys 4MeF3-Phe D-Ala Cys Tyr |
| SEQ ID NO: 2214 Cys Cys Glu ChxIle Cys Cys Asn Pro Ala Cys Thr Gly Cys Ile |
| SEQ ID NO: 2215 Cys Cys Glu ChxIle Cys Cys Asn Pro Ala Cys Ser Gly Cys Ile |
| SEQ ID NO: 2216 Cys Cys Glu ChxIle Cys Cys Asn Pro Ala Cys 4F-Phe Gly Cys Ile |
| SEQ ID NO: 2217 Cys Cys Glu ChxIle Cys Cys Asn Pro Ala Cys 4MeO-Phe Gly Cys Ile |
| SEQ ID NO: 2218 Cys Cys Glu ChxIle Cys Cys Asn Pro Ala Cys 4NO2-Phe Gly Cys Ile |
| SEQ ID NO: 2219 Cys Cys Glu ChxIle Cys Cys Asn Pro Ala Cys 5F-Phe Gly Cys Ile |
| SEQ ID NO: 2220 Cys Cys Glu ChxIle Cys Cys Asn Pro Ala Cys 4MeF3-Phe Gly Cys Ile |
| SEQ ID NO: 2221 Cys Cys Glu ChxIle Cys Cys Asn Pro Ala Cys Thr Gly Cys Trp |
| SEQ ID NO: 2222 Cys Cys Glu ChxIle Cys Cys Asn Pro Ala Cys Ser Gly Cys Trp |
| SEQ ID NO: 2223 Cys Cys Glu ChxIle Cys Cys Asn Pro Ala Cys 4F-Phe Gly Cys Trp |
| SEQ ID NO: 2224 Cys Cys Glu ChxIle Cys Cys Asn Pro Ala Cys 4MeO-Phe Gly Cys Trp |
| SEQ ID NO: 2225 Cys Cys Glu ChxIle Cys Cys Asn Pro Ala Cys 4NO2-Phe Gly Cys Trp |
| SEQ ID NO: 2226 Cys Cys Glu ChxIle Cys Cys Asn Pro Ala Cys 5F-Phe Gly Cys Trp |
| SEQ ID NO: 2227 Cys Cys Glu ChxIle Cys Cys Asn Pro Ala Cys 4MeF3-Phe Gly Cys Trp |
| SEQ ID NO: 2228 Cys Cys Glu Phe Cys Cys Asn Pro Ala Cys Thr D-Ala Cys Tyr |
| SEQ ID NO: 2229 Cys Cys Glu Phe Cys Cys Asn Pro Ala Cys Ser D-Ala Cys Tyr |
| SEQ ID NO: 2230 Cys Cys Glu Phe Cys Cys Asn Pro Ala Cys 4F-Phe D-Ala Cys Tyr |
| SEQ ID NO: 2231 Cys Cys Glu Phe Cys Cys Asn Pro Ala Cys 4MeO-Phe D-Ala Cys Tyr |
| SEQ ID NO: 2232 Cys Cys Glu Phe Cys Cys Asn Pro Ala Cys 4NO2-Phe D-Ala Cys Tyr |
| SEQ ID NO: 2233 Cys Cys Glu Phe Cys Cys Asn Pro Ala Cys 5F-Phe D-Ala Cys Tyr |
| SEQ ID NO: 2234 Cys Cys Glu Phe Cys Cys Asn Pro Ala Cys 4MeF3-Phe D-Ala Cys Tyr |
| SEQ ID NO: 2235 Cys Cys Glu Phe Cys Cys Asn Pro Ala Cys Thr Gly Cys Ile |
| SEQ ID NO: 2236 Cys Cys Glu Phe Cys Cys Asn Pro Ala Cys Ser Gly Cys Ile |
| SEQ ID NO: 2237 Cys Cys Glu Phe Cys Cys Asn Pro Ala Cys 4F-Phe Gly Cys Ile |
| SEQ ID NO: 2238 Cys Cys Glu Phe Cys Cys Asn Pro Ala Cys 4MeO-Phe Gly Cys Ile |
| SEQ ID NO: 2239 Cys Cys Glu Phe Cys Cys Asn Pro Ala Cys 4NO2-Phe Gly Cys Ile |
| SEQ ID NO: 2240 Cys Cys Glu Phe Cys Cys Asn Pro Ala Cys 5F-Phe Gly Cys Ile |
| SEQ ID NO: 2241 Cys Cys Glu Phe Cys Cys Asn Pro Ala Cys 4MeF3-Phe Gly Cys Ile |
| SEQ ID NO: 2242 Cys Cys Glu Phe Cys Cys Asn Pro Ala Cys Thr Gly Cys Trp |
| SEQ ID NO: 2243 Cys Cys Glu Phe Cys Cys Asn Pro Ala Cys Ser Gly Cys Trp |
| SEQ ID NO: 2244 Cys Cys Glu Phe Cys Cys Asn Pro Ala Cys 4F-Phe Gly Cys Trp |

TABLE 3C-continued

Triple substitutions from Scheme 1

SEQ ID NO: 2245  Cys Cys Glu Phe Cys Cys Asn Pro Ala Cys 4MeO-Phe Gly Cys Trp
SEQ ID NO: 2246  Cys Cys Glu Phe Cys Cys Asn Pro Ala Cys 4NO2-Phe Gly Cys Trp
SEQ ID NO: 2247  Cys Cys Glu Phe Cys Cys Asn Pro Ala Cys 5F-Phe Gly Cys Trp
SEQ ID NO: 2248  Cys Cys Glu Phe Cys Cys Asn Pro Ala Cys 4MeF3-Phe Gly Cys Trp
SEQ ID NO: 2249  Cys Cys Glu Tyr Cys Cys Asn Pro Ala Cys Thr D-Ala Cys Tyr
SEQ ID NO: 2250  Cys Cys Glu Tyr Cys Cys Asn Pro Ala Cys Ser D-Ala Cys Tyr
SEQ ID NO: 2251  Cys Cys Glu Tyr Cys Cys Asn Pro Ala Cys 4F-Phe D-Ala Cys Tyr
SEQ ID NO: 2252  Cys Cys Glu Tyr Cys Cys Asn Pro Ala Cys 4MeO-Phe D-Ala Cys Tyr
SEQ ID NO: 2253  Cys Cys Glu Tyr Cys Cys Asn Pro Ala Cys 4NO2-Phe D-Ala Cys Tyr
SEQ ID NO: 2254  Cys Cys Glu Tyr Cys Cys Asn Pro Ala Cys 5F-Phe D-Ala Cys Tyr
SEQ ID NO: 2255  Cys Cys Glu Tyr Cys Cys Asn Pro Ala Cys 4MeF3-Phe D-Ala Cys Tyr
SEQ ID NO: 2256  Cys Cys Glu Tyr Cys Cys Asn Pro Ala Cys Thr Gly Cys Ile
SEQ ID NO: 2257  Cys Cys Glu Tyr Cys Cys Asn Pro Ala Cys Ser Gly Cys Ile
SEQ ID NO: 2258  Cys Cys Glu Tyr Cys Cys Asn Pro Ala Cys 4F-Phe Gly Cys Ile
SEQ ID NO: 2259  Cys Cys Glu Tyr Cys Cys Asn Pro Ala Cys 4MeO-Phe Gly Cys Ile
SEQ ID NO: 2260  Cys Cys Glu Tyr Cys Cys Asn Pro Ala Cys 4NO2-Phe Gly Cys Ile
SEQ ID NO: 2261  Cys Cys Glu Tyr Cys Cys Asn Pro Ala Cys 5F-Phe Gly Cys Ile
SEQ ID NO: 2262  Cys Cys Glu Tyr Cys Cys Asn Pro Ala Cys 4MeF3-Phe Gly Cys Ile
SEQ ID NO: 2263  Cys Cys Glu Tyr Cys Cys Asn Pro Ala Cys Thr Gly Cys Trp
SEQ ID NO: 2264  Cys Cys Glu Tyr Cys Cys Asn Pro Ala Cys Ser Gly Cys Trp
SEQ ID NO: 2265  Cys Cys Glu Tyr Cys Cys Asn Pro Ala Cys 4F-Phe Gly Cys Trp
SEQ ID NO: 2266  Cys Cys Glu Tyr Cys Cys Asn Pro Ala Cys 4MeO-Phe Gly Cys Trp
SEQ ID NO: 2267  Cys Cys Glu Tyr Cys Cys Asn Pro Ala Cys 4NO2-Phe Gly Cys Trp
SEQ ID NO: 2268  Cys Cys Glu Tyr Cys Cys Asn Pro Ala Cys 5F-Phe Gly Cys Trp
SEQ ID NO: 2269  Cys Cys Glu Tyr Cys Cys Asn Pro Ala Cys 4MeF3-Phe Gly Cys Trp
SEQ ID NO: 2270  Cys Cys Glu Dopa Cys Cys Asn Pro Ala Cys Thr D-Ala Cys Tyr
SEQ ID NO: 2271  Cys Cys Glu Dopa Cys Cys Asn Pro Ala Cys Ser D-Ala Cys Tyr
SEQ ID NO: 2272  Cys Cys Glu Dopa Cys Cys Asn Pro Ala Cys 4F-Phe D-Ala Cys Tyr
SEQ ID NO: 2273  Cys Cys Glu Dopa Cys Cys Asn Pro Ala Cys 4MeO-Phe D-Ala Cys Tyr
SEQ ID NO: 2274  Cys Cys Glu Dopa Cys Cys Asn Pro Ala Cys 4NO2-Phe D-Ala Cys Tyr
SEQ ID NO: 2275  Cys Cys Glu Dopa Cys Cys Asn Pro Ala Cys 5F-Phe D-Ala Cys Tyr
SEQ ID NO: 2276  Cys Cys Glu Dopa Cys Cys Asn Pro Ala Cys 4MeF3-Phe D-Ala Cys Tyr
SEQ ID NO: 2277  Cys Cys Glu Dopa Cys Cys Asn Pro Ala Cys Thr Gly Cys Ile
SEQ ID NO: 2278  Cys Cys Glu Dopa Cys Cys Asn Pro Ala Cys Ser Gly Cys Ile
SEQ ID NO: 2279  Cys Cys Glu Dopa Cys Cys Asn Pro Ala Cys 4F-Phe Gly Cys Ile
SEQ ID NO: 2280  Cys Cys Glu Dopa Cys Cys Asn Pro Ala Cys 4MeO-Phe Gly Cys Ile
SEQ ID NO: 2281  Cys Cys Glu Dopa Cys Cys Asn Pro Ala Cys 4NO2-Phe Gly Cys Ile
SEQ ID NO: 2282  Cys Cys Glu Dopa Cys Cys Asn Pro Ala Cys 5F-Phe Gly Cys Ile
SEQ ID NO: 2283  Cys Cys Glu Dopa Cys Cys Asn Pro Ala Cys 4MeF3-Phe Gly Cys Ile TABLE 3C-continued Triple substitutions from Scheme 1

SEQ ID NO: 2284  Cys Cys Glu Dopa Cys Cys Asn Pro Ala Cys Thr Gly Cys Trp
SEQ ID NO: 2285  Cys Cys Glu Dopa Cys Cys Asn Pro Ala Cys Ser Gly Cys Trp
SEQ ID NO: 2286  Cys Cys Glu Dopa Cys Cys Asn Pro Ala Cys 4F-Phe Gly Cys Trp
SEQ ID NO: 2287  Cys Cys Glu Dopa Cys Cys Asn Pro Ala Cys 4MeO-Phe Gly Cys Trp
SEQ ID NO: 2288  Cys Cys Glu Dopa Cys Cys Asn Pro Ala Cys 4NO2-Phe Gly Cys Trp
SEQ ID NO: 2289  Cys Cys Glu Dopa Cys Cys Asn Pro Ala Cys 5F-Phe Gly Cys Trp
SEQ ID NO: 2290  Cys Cys Glu Dopa Cys Cys Asn Pro Ala Cys 4MeF3-Phe Gly Cys Trp
SEQ ID NO: 2291  Cys Cys Glu NMe-Leu Cys Cys Asn Pro Ala Cys Thr D-Ala Cys Tyr
SEQ ID NO: 2292  Cys Cys Glu NMe-Leu Cys Cys Asn Pro Ala Cys Ser D-Ala Cys Tyr
SEQ ID NO: 2293  Cys Cys Glu NMe-Leu Cys Cys Asn Pro Ala Cys 4F-Phe D-Ala Cys Tyr
SEQ ID NO: 2294  Cys Cys Glu NMe-Leu Cys Cys Asn Pro Ala Cys 4MeO-Phe D-Ala Cys Tyr
SEQ ID NO: 2295  Cys Cys Glu NMe-Leu Cys Cys Asn Pro Ala Cys 4NO2-Phe D-Ala Cys Tyr
SEQ ID NO: 2296  Cys Cys Glu NMe-Leu Cys Cys Asn Pro Ala Cys 5F-Phe D-Ala Cys Tyr
SEQ ID NO: 2297  Cys Cys Glu NMe-Leu Cys Cys Asn Pro Ala Cys 4MeF3-Phe D-Ala Cys Tyr
SEQ ID NO: 2298  Cys Cys Glu NMe-Leu Cys Cys Asn Pro Ala Cys Thr Gly Cys Ile
SEQ ID NO: 2299  Cys Cys Glu NMe-Leu Cys Cys Asn Pro Ala Cys Ser Gly Cys Ile
SEQ ID NO: 2300  Cys Cys Glu NMe-Leu Cys Cys Asn Pro Ala Cys 4F-Phe Gly Cys Ile
SEQ ID NO: 2301  Cys Cys Glu NMe-Leu Cys Cys Asn Pro Ala Cys 4MeO-Phe Gly Cys Ile
SEQ ID NO: 2302  Cys Cys Glu NMe-Leu Cys Cys Asn Pro Ala Cys 4NO2-Phe Gly Cys Ile
SEQ ID NO: 2303  Cys Cys Glu NMe-Leu Cys Cys Asn Pro Ala Cys 5F-Phe Gly Cys Ile
SEQ ID NO: 2304  Cys Cys Glu NMe-Leu Cys Cys Asn Pro Ala Cys 4MeF3-Phe Gly Cys Ile
SEQ ID NO: 2305  Cys Cys Glu NMe-Leu Cys Cys Asn Pro Ala Cys Thr Gly Cys Trp
SEQ ID NO: 2306  Cys Cys Glu NMe-Leu Cys Cys Asn Pro Ala Cys Ser Gly Cys Trp
SEQ ID NO: 2307  Cys Cys Glu NMe-Leu Cys Cys Asn Pro Ala Cys 4F-Phe Gly Cys Trp
SEQ ID NO: 2308  Cys Cys Glu NMe-Leu Cys Cys Asn Pro Ala Cys 4MeO-Phe Gly Cys Trp
SEQ ID NO: 2309  Cys Cys Glu NMe-Leu Cys Cys Asn Pro Ala Cys 4NO2-Phe Gly Cys Trp
SEQ ID NO: 2310  Cys Cys Glu NMe-Leu Cys Cys Asn Pro Ala Cys 5F-Phe Gly Cys Trp
SEQ ID NO: 2311  Cys Cys Glu NMe-Leu Cys Cys Asn Pro Ala Cys 4MeF3-Phe Gly Cys Trp
SEQ ID NO: 2312  Cys Cys Glu Thr Cys Cys Asn Pro Ala Cys Ala D-Ala Cys Ile
SEQ ID NO: 2313  Cys Cys Glu Thr Cys Cys Asn Pro Ala Cys Ala D-Ala Cys Trp
SEQ ID NO: 2314  Cys Cys Glu hLeu Cys Cys Asn Pro Ala Cys Ala D-Ala Cys Ile
SEQ ID NO: 2315  Cys Cys Glu hLeu Cys Cys Asn Pro Ala Cys Ala D-Ala Cys Trp
SEQ ID NO: 2316  Cys Cys Glu norLeu Cys Cys Asn Pro Ala Cys Ala D-Ala Cys Ile
SEQ ID NO: 2317  Cys Cys Glu norLeu Cys Cys Asn Pro Ala Cys Ala D-Ala Cys Trp
SEQ ID NO: 2318  Cys Cys Glu ChxAla Cys Cys Asn Pro Ala Cys Ala D-Ala Cys Ile
SEQ ID NO: 2319  Cys Cys Glu ChxAla Cys Cys Asn Pro Ala Cys Ala D-Ala Cys Trp
SEQ ID NO: 2320  Cys Cys Glu ChxIle Cys Cys Asn Pro Ala Cys Ala D-Ala Cys Ile
SEQ ID NO: 2321  Cys Cys Glu ChxIle Cys Cys Asn Pro Ala Cys Ala D-Ala Cys Trp
SEQ ID NO: 2322  Cys Cys Glu Phe Cys Cys Asn Pro Ala Cys Ala D-Ala Cys Ile TABLE 3C-continued Triple substitutions from Scheme 1

SEQ ID NO: 2323  Cys Cys Glu Phe Cys Cys Asn Pro Ala Cys Ala D-Ala Cys Trp
SEQ ID NO: 2324  Cys Cys Glu Tyr Cys Cys Asn Pro Ala Cys Ala D-Ala Cys Ile
SEQ ID NO: 2325  Cys Cys Glu Tyr Cys Cys Asn Pro Ala Cys Ala D-Ala Cys Trp
SEQ ID NO: 2326  Cys Cys Glu Dopa Cys Cys Asn Pro Ala Cys Ala D-Ala Cys Ile
SEQ ID NO: 2327  Cys Cys Glu Dopa Cys Cys Asn Pro Ala Cys Ala D-Ala Cys Trp
SEQ ID NO: 2328  Cys Cys Glu NMe-Leu Cys Cys Asn Pro Ala Cys Ala D-Ala Cys Ile
SEQ ID NO: 2329  Cys Cys Glu NMe-Leu Cys Cys Asn Pro Ala Cys Ala D-Ala Cys Trp
SEQ ID NO: 2330  Cys Cys Glu Leu Cys Cys Asn Dhp Ala Cys Thr D-Ala Cys Tyr
SEQ ID NO: 2331  Cys Cys Glu Leu Cys Cys Asn Dhp Ala Cys Ser D-Ala Cys Tyr
SEQ ID NO: 2332  Cys Cys Glu Leu Cys Cys Asn Dhp Ala Cys 4F-Phe D-Ala Cys Tyr
SEQ ID NO: 2333  Cys Cys Glu Leu Cys Cys Asn Dhp Ala Cys 4MeO-Phe D-Ala Cys Tyr
SEQ ID NO: 2334  Cys Cys Glu Leu Cys Cys Asn Dhp Ala Cys 4NO2-Phe D-Ala Cys Tyr
SEQ ID NO: 2335  Cys Cys Glu Leu Cys Cys Asn Dhp Ala Cys 5F-Phe D-Ala Cys Tyr
SEQ ID NO: 2336  Cys Cys Glu Leu Cys Cys Asn Dhp Ala Cys 4MeF3-Phe D-Ala Cys Tyr
SEQ ID NO: 2337  Cys Cys Glu Leu Cys Cys Asn Dhp Ala Cys Thr Gly Cys Ile
SEQ ID NO: 2338  Cys Cys Glu Leu Cys Cys Asn Dhp Ala Cys Ser Gly Cys Ile
SEQ ID NO: 2339  Cys Cys Glu Leu Cys Cys Asn Dhp Ala Cys 4F-Phe Gly Cys Ile
SEQ ID NO: 2340  Cys Cys Glu Leu Cys Cys Asn Dhp Ala Cys 4MeO-Phe Gly Cys Ile
SEQ ID NO: 2341  Cys Cys Glu Leu Cys Cys Asn Dhp Ala Cys 4NO2-Phe Gly Cys Ile
SEQ ID NO: 2342  Cys Cys Glu Leu Cys Cys Asn Dhp Ala Cys 5F-Phe Gly Cys Ile
SEQ ID NO: 2343  Cys Cys Glu Leu Cys Cys Asn Dhp Ala Cys 4MeF3-Phe Gly Cys Ile
SEQ ID NO: 2344  Cys Cys Glu Leu Cys Cys Asn Dhp Ala Cys Thr Gly Cys Trp
SEQ ID NO: 2345  Cys Cys Glu Leu Cys Cys Asn Dhp Ala Cys Ser Gly Cys Trp
SEQ ID NO: 2346  Cys Cys Glu Leu Cys Cys Asn Dhp Ala Cys 4F-Phe Gly Cys Trp
SEQ ID NO: 2347  Cys Cys Glu Leu Cys Cys Asn Dhp Ala Cys 4MeO-Phe Gly Cys Trp
SEQ ID NO: 2348  Cys Cys Glu Leu Cys Cys Asn Dhp Ala Cys 4NO2-Phe Gly Cys Trp
SEQ ID NO: 2349  Cys Cys Glu Leu Cys Cys Asn Dhp Ala Cys 5F-Phe Gly Cys Trp
SEQ ID NO: 2350  Cys Cys Glu Leu Cys Cys Asn Dhp Ala Cys 4MeF3-Phe Gly Cys Trp
SEQ ID NO: 2351  Cys Cys Glu Leu Cys Cys Asn Thz Ala Cys Thr D-Ala Cys Tyr
SEQ ID NO: 2352  Cys Cys Glu Leu Cys Cys Asn Thz Ala Cys Ser D-Ala Cys Tyr
SEQ ID NO: 2353  Cys Cys Glu Leu Cys Cys Asn Thz Ala Cys 4F-Phe D-Ala Cys Tyr
SEQ ID NO: 2354  Cys Cys Glu Leu Cys Cys Asn Thz Ala Cys 4MeO-Phe D-Ala Cys Tyr
SEQ ID NO: 2355  Cys Cys Glu Leu Cys Cys Asn Thz Ala Cys 4NO2-Phe D-Ala Cys Tyr
SEQ ID NO: 2356  Cys Cys Glu Leu Cys Cys Asn Thz Ala Cys 5F-Phe D-Ala Cys Tyr
SEQ ID NO: 2357  Cys Cys Glu Leu Cys Cys Asn Thz Ala Cys 4MeF3-Phe D-Ala Cys Tyr
SEQ ID NO: 2358  Cys Cys Glu Leu Cys Cys Asn Thz Ala Cys Thr Gly Cys Ile
SEQ ID NO: 2359  Cys Cys Glu Leu Cys Cys Asn Thz Ala Cys Ser Gly Cys Ile
SEQ ID NO: 2360  Cys Cys Glu Leu Cys Cys Asn Thz Ala Cys 4F-Phe Gly Cys Ile
SEQ ID NO: 2361  Cys Cys Glu Leu Cys Cys Asn Thz Ala Cys 4MeO-Phe Gly Cys Ile TABLE 3C-continued Triple substitutions from Scheme 1

| SEQ ID NO: 2362 | Cys Cys Glu Leu Cys Cys Asn Thz Ala Cys 4NO2-Phe Gly Cys Ile |
| SEQ ID NO: 2363 | Cys Cys Glu Leu Cys Cys Asn Thz Ala Cys 5F-Phe Gly Cys Ile |
| SEQ ID NO: 2364 | Cys Cys Glu Leu Cys Cys Asn Thz Ala Cys 4MeF3-Phe Gly Cys Ile |
| SEQ ID NO: 2365 | Cys Cys Glu Leu Cys Cys Asn Thz Ala Cys Thr Gly Cys Trp |
| SEQ ID NO: 2366 | Cys Cys Glu Leu Cys Cys Asn Thz Ala Cys Ser Gly Cys Trp |
| SEQ ID NO: 2367 | Cys Cys Glu Leu Cys Cys Asn Thz Ala Cys 4F-Phe Gly Cys Trp |
| SEQ ID NO: 2368 | Cys Cys Glu Leu Cys Cys Asn Thz Ala Cys 4MeO-Phe Gly Cys Trp |
| SEQ ID NO: 2369 | Cys Cys Glu Leu Cys Cys Asn Thz Ala Cys 4NO2-Phe Gly Cys Trp |
| SEQ ID NO: 2370 | Cys Cys Glu Leu Cys Cys Asn Thz Ala Cys 5F-Phe Gly Cys Trp |
| SEQ ID NO: 2371 | Cys Cys Glu Leu Cys Cys Asn Thz Ala Cys 4MeF3-Phe Gly Cys Trp |
| SEQ ID NO: 2372 | Cys Cys Glu Leu Cys Cys Asn HyPro Ala Cys Thr D-Ala Cys Tyr |
| SEQ ID NO: 2373 | Cys Cys Glu Leu Cys Cys Asn HyPro Ala Cys Ser D-Ala Cys Tyr |
| SEQ ID NO: 2374 | Cys Cys Glu Leu Cys Cys Asn HyPro Ala Cys 4F-Phe D-Ala Cys Tyr |
| SEQ ID NO: 2375 | Cys Cys Glu Leu Cys Cys Asn HyPro Ala Cys 4MeO-Phe D-Ala Cys Tyr |
| SEQ ID NO: 2376 | Cys Cys Glu Leu Cys Cys Asn HyPro Ala Cys 4NO2-Phe D-Ala Cys Tyr |
| SEQ ID NO: 2377 | Cys Cys Glu Leu Cys Cys Asn HyPro Ala Cys 5F-Phe D-Ala Cys Tyr |
| SEQ ID NO: 2378 | Cys Cys Glu Leu Cys Cys Asn HyPro Ala Cys 4MeF3-Phe D-Ala Cys Tyr |
| SEQ ID NO: 2379 | Cys Cys Glu Leu Cys Cys Asn HyPro Ala Cys Thr Gly Cys Ile |
| SEQ ID NO: 2380 | Cys Cys Glu Leu Cys Cys Asn HyPro Ala Cys Ser Gly Cys Ile |
| SEQ ID NO: 2381 | Cys Cys Glu Leu Cys Cys Asn HyPro Ala Cys 4F-Phe Gly Cys Ile |
| SEQ ID NO: 2382 | Cys Cys Glu Leu Cys Cys Asn HyPro Ala Cys 4MeO-Phe Gly Cys Ile |
| SEQ ID NO: 2383 | Cys Cys Glu Leu Cys Cys Asn HyPro Ala Cys 4NO2-Phe Gly Cys Ile |
| SEQ ID NO: 2384 | Cys Cys Glu Leu Cys Cys Asn HyPro Ala Cys 5F-Phe Gly Cys Ile |
| SEQ ID NO: 2385 | Cys Cys Glu Leu Cys Cys Asn HyPro Ala Cys 4MeF3-Phe Gly Cys Ile |
| SEQ ID NO: 2386 | Cys Cys Glu Leu Cys Cys Asn HyPro Ala Cys Thr Gly Cys Trp |
| SEQ ID NO: 2387 | Cys Cys Glu Leu Cys Cys Asn HyPro Ala Cys Ser Gly Cys Trp |
| SEQ ID NO: 2388 | Cys Cys Glu Leu Cys Cys Asn HyPro Ala Cys 4F-Phe Gly Cys Trp |
| SEQ ID NO: 2389 | Cys Cys Glu Leu Cys Cys Asn HyPro Ala Cys 4MeO-Phe Gly Cys Trp |
| SEQ ID NO: 2390 | Cys Cys Glu Leu Cys Cys Asn HyPro Ala Cys 4NO2-Phe Gly Cys Trp |
| SEQ ID NO: 2391 | Cys Cys Glu Leu Cys Cys Asn HyPro Ala Cys 5F-Phe Gly Cys Trp |
| SEQ ID NO: 2392 | Cys Cys Glu Leu Cys Cys Asn HyPro Ala Cys 4MeF3-Phe Gly Cys Trp |
| SEQ ID NO: 2393 | Cys Cys Glu Leu Cys Cys Asn Pip Ala Cys Thr D-Ala Cys Tyr |
| SEQ ID NO: 2394 | Cys Cys Glu Leu Cys Cys Asn Pip Ala Cys Ser D-Ala Cys Tyr |
| SEQ ID NO: 2395 | Cys Cys Glu Leu Cys Cys Asn Pip Ala Cys 4F-Phe D-Ala Cys Tyr |
| SEQ ID NO: 2396 | Cys Cys Glu Leu Cys Cys Asn Pip Ala Cys 4MeO-Phe D-Ala Cys Tyr |
| SEQ ID NO: 2397 | Cys Cys Glu Leu Cys Cys Asn Pip Ala Cys 4NO2-Phe D-Ala Cys Tyr |
| SEQ ID NO: 2398 | Cys Cys Glu Leu Cys Cys Asn Pip Ala Cys 5F-Phe D-Ala Cys Tyr |
| SEQ ID NO: 2399 | Cys Cys Glu Leu Cys Cys Asn Pip Ala Cys 4MeF3-Phe D-Ala Cys Tyr |
| SEQ ID NO: 2400 | Cys Cys Glu Leu Cys Cys Asn Pip Ala Cys Thr Gly Cys Ile |

TABLE 3C-continued

Triple substitutions from Scheme 1

| SEQ ID NO: 2401 | Cys Cys Glu Leu Cys Cys Asn Pip Ala Cys Ser Gly Cys Ile |
| SEQ ID NO: 2402 | Cys Cys Glu Leu Cys Cys Asn Pip Ala Cys 4F-Phe Gly Cys Ile |
| SEQ ID NO: 2403 | Cys Cys Glu Leu Cys Cys Asn Pip Ala Cys 4MeO-Phe Gly Cys Ile |
| SEQ ID NO: 2404 | Cys Cys Glu Leu Cys Cys Asn Pip Ala Cys 4NO2-Phe Gly Cys Ile |
| SEQ ID NO: 2405 | Cys Cys Glu Leu Cys Cys Asn Pip Ala Cys 5F-Phe Gly Cys Ile |
| SEQ ID NO: 2406 | Cys Cys Glu Leu Cys Cys Asn Pip Ala Cys 4MeF3-Phe Gly Cys Ile |
| SEQ ID NO: 2407 | Cys Cys Glu Leu Cys Cys Asn Pip Ala Cys Thr Gly Cys Trp |
| SEQ ID NO: 2408 | Cys Cys Glu Leu Cys Cys Asn Pip Ala Cys Ser Gly Cys Trp |
| SEQ ID NO: 2409 | Cys Cys Glu Leu Cys Cys Asn Pip Ala Cys 4F-Phe Gly Cys Trp |
| SEQ ID NO: 2410 | Cys Cys Glu Leu Cys Cys Asn Pip Ala Cys 4MeO-Phe Gly Cys Trp |
| SEQ ID NO: 2411 | Cys Cys Glu Leu Cys Cys Asn Pip Ala Cys 4NO2-Phe Gly Cys Trp |
| SEQ ID NO: 2412 | Cys Cys Glu Leu Cys Cys Asn Pip Ala Cys 5F-Phe Gly Cys Trp |
| SEQ ID NO: 2413 | Cys Cys Glu Leu Cys Cys Asn Pip Ala Cys 4MeF3-Phe Gly Cys Trp |
| SEQ ID NO: 2414 | Cys Cys Glu Leu Cys Cys Asn Ile Ala Cys Thr D-Ala Cys Tyr |
| SEQ ID NO: 2415 | Cys Cys Glu Leu Cys Cys Asn Ile Ala Cys Ser D-Ala Cys Tyr |
| SEQ ID NO: 2416 | Cys Cys Glu Leu Cys Cys Asn Ile Ala Cys 4F-Phe D-Ala Cys Tyr |
| SEQ ID NO: 2417 | Cys Cys Glu Leu Cys Cys Asn Ile Ala Cys 4MeO-Phe D-Ala Cys Tyr |
| SEQ ID NO: 2418 | Cys Cys Glu Leu Cys Cys Asn Ile Ala Cys 4NO2-Phe D-Ala Cys Tyr |
| SEQ ID NO: 2419 | Cys Cys Glu Leu Cys Cys Asn Ile Ala Cys 5F-Phe D-Ala Cys Tyr |
| SEQ ID NO: 2420 | Cys Cys Glu Leu Cys Cys Asn Ile Ala Cys 4MeF3-Phe D-Ala Cys Tyr |
| SEQ ID NO: 2421 | Cys Cys Glu Leu Cys Cys Asn Ile Ala Cys Thr Gly Cys Ile |
| SEQ ID NO: 2422 | Cys Cys Glu Leu Cys Cys Asn Ile Ala Cys Ser Gly Cys Ile |
| SEQ ID NO: 2423 | Cys Cys Glu Leu Cys Cys Asn Ile Ala Cys 4F-Phe Gly Cys Ile |
| SEQ ID NO: 2424 | Cys Cys Glu Leu Cys Cys Asn Ile Ala Cys 4MeO-Phe Gly Cys Ile |
| SEQ ID NO: 2425 | Cys Cys Glu Leu Cys Cys Asn Ile Ala Cys 4NO2-Phe Gly Cys Ile |
| SEQ ID NO: 2426 | Cys Cys Glu Leu Cys Cys Asn Ile Ala Cys 5F-Phe Gly Cys Ile |
| SEQ ID NO: 2427 | Cys Cys Glu Leu Cys Cys Asn Ile Ala Cys 4MeF3-Phe Gly Cys Ile |
| SEQ ID NO: 2428 | Cys Cys Glu Leu Cys Cys Asn Ile Ala Cys Thr Gly Cys Trp |
| SEQ ID NO: 2429 | Cys Cys Glu Leu Cys Cys Asn Ile Ala Cys Ser Gly Cys Trp |
| SEQ ID NO: 2430 | Cys Cys Glu Leu Cys Cys Asn Ile Ala Cys 4F-Phe Gly Cys Trp |
| SEQ ID NO: 2431 | Cys Cys Glu Leu Cys Cys Asn Ile Ala Cys 4MeO-Phe Gly Cys Trp |
| SEQ ID NO: 2432 | Cys Cys Glu Leu Cys Cys Asn Ile Ala Cys 4NO2-Phe Gly Cys Trp |
| SEQ ID NO: 2433 | Cys Cys Glu Leu Cys Cys Asn Ile Ala Cys 5F-Phe Gly Cys Trp |
| SEQ ID NO: 2434 | Cys Cys Glu Leu Cys Cys Asn Ile Ala Cys 4MeF3-Phe Gly Cys Trp |
| SEQ ID NO: 2435 | Cys Cys Glu Leu Cys Cys Asn Ala Ala Cys Thr D-Ala Cys Tyr |
| SEQ ID NO: 2436 | Cys Cys Glu Leu Cys Cys Asn Ala Ala Cys Ser D-Ala Cys Tyr |
| SEQ ID NO: 2437 | Cys Cys Glu Leu Cys Cys Asn Ala Ala Cys 4F-Phe D-Ala Cys Tyr |
| SEQ ID NO: 2438 | Cys Cys Glu Leu Cys Cys Asn Ala Ala Cys 4MeO-Phe D-Ala Cys Tyr |
| SEQ ID NO: 2439 | Cys Cys Glu Leu Cys Cys Asn Ala Ala Cys 4NO2-Phe D-Ala Cys Tyr |

TABLE 3C-continued

Triple substitutions from Scheme 1

| SEQ ID NO: 2440 | Cys Cys Glu Leu Cys Cys Asn Ala Ala Cys 5F-Phe D-Ala Cys Tyr |
| SEQ ID NO: 2441 | Cys Cys Glu Leu Cys Cys Asn Ala Ala Cys 4MeF3-Phe D-Ala Cys Tyr |
| SEQ ID NO: 2442 | Cys Cys Glu Leu Cys Cys Asn Ala Ala Cys Thr Gly Cys Ile |
| SEQ ID NO: 2443 | Cys Cys Glu Leu Cys Cys Asn Ala Ala Cys Ser Gly Cys Ile |
| SEQ ID NO: 2444 | Cys Cys Glu Leu Cys Cys Asn Ala Ala Cys 4F-Phe Gly Cys Ile |
| SEQ ID NO: 2445 | Cys Cys Glu Leu Cys Cys Asn Ala Ala Cys 4MeO-Phe Gly Cys Ile |
| SEQ ID NO: 2446 | Cys Cys Glu Leu Cys Cys Asn Ala Ala Cys 4NO2-Phe Gly Cys Ile |
| SEQ ID NO: 2447 | Cys Cys Glu Leu Cys Cys Asn Ala Ala Cys 5F-Phe Gly Cys Ile |
| SEQ ID NO: 2448 | Cys Cys Glu Leu Cys Cys Asn Ala Ala Cys 4MeF3-Phe Gly Cys Ile |
| SEQ ID NO: 2449 | Cys Cys Glu Leu Cys Cys Asn Ala Ala Cys Thr Gly Cys Trp |
| SEQ ID NO: 2450 | Cys Cys Glu Leu Cys Cys Asn Ala Ala Cys Ser Gly Cys Trp |
| SEQ ID NO: 2451 | Cys Cys Glu Leu Cys Cys Asn Ala Ala Cys 4F-Phe Gly Cys Trp |
| SEQ ID NO: 2452 | Cys Cys Glu Leu Cys Cys Asn Ala Ala Cys 4MeO-Phe Gly Cys Trp |
| SEQ ID NO: 2453 | Cys Cys Glu Leu Cys Cys Asn Ala Ala Cys 4NO2-Phe Gly Cys Trp |
| SEQ ID NO: 2454 | Cys Cys Glu Leu Cys Cys Asn Ala Ala Cys 5F-Phe Gly Cys Trp |
| SEQ ID NO: 2455 | Cys Cys Glu Leu Cys Cys Asn Ala Ala Cys 4MeF3-Phe Gly Cys Trp |
| SEQ ID NO: 2456 | Cys Cys Glu Leu Cys Cys Asn Dhp Ala Cys Ala D-Ala Cys Ile |
| SEQ ID NO: 2457 | Cys Cys Glu Leu Cys Cys Asn Dhp Ala Cys Ala D-Ala Cys Trp |
| SEQ ID NO: 2458 | Cys Cys Glu Leu Cys Cys Asn Thz Ala Cys Ala D-Ala Cys Ile |
| SEQ ID NO: 2459 | Cys Cys Glu Leu Cys Cys Asn Thz Ala Cys Ala D-Ala Cys Trp |
| SEQ ID NO: 2460 | Cys Cys Glu Leu Cys Cys Asn HyPro Ala Cys Ala D-Ala Cys Ile |
| SEQ ID NO: 2461 | Cys Cys Glu Leu Cys Cys Asn HyPro Ala Cys Ala D-Ala Cys Trp |
| SEQ ID NO: 2462 | Cys Cys Glu Leu Cys Cys Asn Pip Ala Cys Ala D-Ala Cys Ile |
| SEQ ID NO: 2463 | Cys Cys Glu Leu Cys Cys Asn Pip Ala Cys Ala D-Ala Cys Trp |
| SEQ ID NO: 2464 | Cys Cys Glu Leu Cys Cys Asn Ile Ala Cys Ala D-Ala Cys Ile |
| SEQ ID NO: 2465 | Cys Cys Glu Leu Cys Cys Asn Ile Ala Cys Ala D-Ala Cys Trp |
| SEQ ID NO: 2466 | Cys Cys Glu Leu Cys Cys Asn Ala Ala Cys Ala D-Ala Cys Ile |
| SEQ ID NO: 2467 | Cys Cys Glu Leu Cys Cys Asn Ala Ala Cys Ala D-Ala Cys Trp |
| SEQ ID NO: 2468 | Cys Cys Glu Leu Cys Cys Asn Pro Ala Cys Thr D-Ala Cys Ile |
| SEQ ID NO: 2469 | Cys Cys Glu Leu Cys Cys Asn Pro Ala Cys Thr D-Ala Cys Trp |
| SEQ ID NO: 2470 | Cys Cys Glu Leu Cys Cys Asn Pro Ala Cys Ser D-Ala Cys Ile |
| SEQ ID NO: 2471 | Cys Cys Glu Leu Cys Cys Asn Pro Ala Cys Ser D-Ala Cys Trp |
| SEQ ID NO: 2472 | Cys Cys Glu Leu Cys Cys Asn Pro Ala Cys 4F-Phe D-Ala Cys Ile |
| SEQ ID NO: 2473 | Cys Cys Glu Leu Cys Cys Asn Pro Ala Cys 4F-Phe D-Ala Cys Trp |
| SEQ ID NO: 2474 | Cys Cys Glu Leu Cys Cys Asn Pro Ala Cys 4MeO-Phe D-Ala Cys Ile |
| SEQ ID NO: 2475 | Cys Cys Glu Leu Cys Cys Asn Pro Ala Cys 4MeO-Phe D-Ala Cys Trp |
| SEQ ID NO: 2476 | Cys Cys Glu Leu Cys Cys Asn Pro Ala Cys 4NO2-Phe D-Ala Cys Ile |
| SEQ ID NO: 2477 | Cys Cys Glu Leu Cys Cys Asn Pro Ala Cys 4NO2-Phe D-Ala Cys Trp |
| SEQ ID NO: 2478 | Cys Cys Glu Leu Cys Cys Asn Pro Ala Cys 5F-Phe D-Ala Cys Ile |

TABLE 3C-continued

Triple substitutions from Scheme 1

SEQ ID NO: 2479  Cys Cys Glu Leu Cys Cys Asn Pro Ala Cys 5F-Phe D-Ala Cys Trp

SEQ ID NO: 2480  Cys Cys Glu Leu Cys Cys Asn Pro Ala Cys 4MeF3-Phe D-Ala Cys Ile

SEQ ID NO: 2481  Cys Cys Glu Leu Cys Cys Asn Pro Ala Cys 4MeF3-Phe D-Ala Cys Trp

Scheme 2 shows the peptide sequences of the invention and the location of residues that may be modified, and exemplary modifications that may be made at each residue, to result in a therapeutic peptide.

SCHEME 2

| | (N-term. tail) | | | | | | | CORE: | | | | | | | | | | (C-term.) | |
|---|---|---|---|---|---|---|---|---|---|---|---|---|---|---|---|---|---|---|---|
| | | | | | | | | position-no.: | | | | | | | | | | | |
| | 1 | 2 | 3 | 4 | 5 | 6 | 7 | 8 | 9 | 10 | 11 | 12 | 13 | 14 | 15 | 16 | 17 | 18 | 19 |
| | | | | | | | | sequence: | | | | | | | | | | | |
| | Asn | Thr | Phe | Tyr | Cys | Cys | Glu | Leu | Cys | Cys | Asn | Pro | Ala | Cys | Ala | Gly | Cys | Tyr | Tyr |
| substitutions: | Ser | Ser | Tyr | Phe | Pen | Pen | Ser | Thr | Pen | Pen | | Dhp | | Pen | Thr | D-Ala | Pen | | |
| | Thr | Asn | | Trp | Mpr | | hSer | hLeu | | | | Thz | | | Ser | | | Phe | Phe |
| | | | | | | | Csa | norLeu | | | | HyPro | | | 4F-Phe | | | Ile | Ile |
| | | | | | | | | ChxAla | | | | Pip | | | 4MeO-Phe | | | Trp | Trp |
| | | | | | | | | ChxIle | | | | Ile | | | 4NO2-Phe | | | | |
| | | | | | | | | Phe | | | | Ala | | | 5F-Phe | | | | |
| | | | | | | | | Tyr | | | | | | | 4MeF3-Phe | | | | |
| | | | | | | | | Dopa | | | | PRa | | | | | | | |
| | | | | | | | | NMe-Leu | | | | PRb | | | PHa | | | | |
| | | | | | | | | | | | | PRc | | | PHb | | | | |
| | | | | | | | | THa | | | | PRd | | | PHc | | | | |
| | | | | | | | | THb | | | | PRe | | | PHd | | | | |
| | | | | | | | | THc | | | | PRf | | | PHq | | | | |
| | | | | | | | | THd | | | | PRg | | | PHf | | | | |
| | | | | | | | | THe | | | | PRh | | | PHg | | | | |
| | | | | | | | | THf | | | | PRi | | | PHh | | | | |
| | | | | | | | | THg | | | | PRj | | | PHi | | | | |
| | | | | | | | | THh | | | | PRk | | | PHj | | | | |
| | | | | | | | | THi | | | | PRl | | | PHk | | | | |
| | | | | | | | | THj | | | | PRm | | | PHl | | | | |
| | | | | | | | | THk | | | | PRn | | | PHm | | | | |
| | | | | | | | | THl | | | | PRq | | | PHn | | | | |
| | | | | | | | | | | | | PRp | | | PHo | | | | |
| | | | | | | | | | | | | | | | PHp | | | | |

TABLE 4

Abbreviations used in Scheme 2:

| | |
|---|---|
| Pen = | Penicillamine |
| hSer = | Homoserine, Hse |
| Csa = | Cysteic Acid |
| hLeu = | Homoleucine, Hle |
| norLeu = | Norleucine, Nle |
| ChxAla = | Cyclohexyl-Aalanine, Cha |
| ChxIle = | Cyclohexyl-Isoleucine, Chi |
| Dopa = | L-Dopa, L-dihydroxyphenylalanine |
| Dhp = | 3,4,-dihydro-Proline, D-Pro 3,4-Dehydroproline |
| Thz = | Thiazolidine (4-thiazolidine-2-carboxylic acid), Tzd |
| HyPro = | Hydroxy-Proline, Hyp, Hydroxyproline |
| Pip = | L-Pipecolic Acid |
| 4F-Phe = | 4-fluoro-Phenylalanine, Phe(4-F), 4-fluorophenylalanine |
| 4MeO-Phe = | 4-methoxy-Phenylalanine, Phe(4-OMe), 4-methoxyphenylalanine |
| 4NO2-Phe = | 4-nitro-Phenylalanine, Phe(4-NO2), 4-Nitrophenylalanine |
| 5F-Phe = | Pentafluoro-Phenylalanine, Phe(3-F), 3-fluorophenylalanine |
| 4MeF3-Phe = | Phe(4-MeF3), 4-trifluoromethylphenylalanine |
| NMe-Leu = | N-methyl-leucine, MeLeu, N-Methylleucine |
| D-Ala = | D-Alanine |
| Mpr = | 3-mercaptoproprionic acid |
| □ = | none (or deletion) |

TABLE 4-continued

| Abbreviations used in Scheme 2: | |
|---|---|
| natural amino acids | (L-amino acids unless otherwise stated) |
| Ala = | Alanine |
| Arg = | Arginine |
| Asn = | Asparagine |
| Asp = | Aspartic acid |
| Cys = | Cysteine |
| Glu = | Glutamic acid |
| Gln = | Glutamine |
| Gly = | Glycine |
| His = | Histidine |
| Ile = | Isoleucine |
| Leu = | Leucine |
| Lys = | Lysine |
| Met = | Methionine |
| Phe = | Phenylalanine |
| Pro = | Proline |
| Ser = | Serine |
| Thr = | Threonine |
| Try = | Tryptophan |
| Tyr = | Tyrosine |
| Val = | Valine |
| THa = | (S)-2-amino-3-hydroxypropanoic acid |
| THb = | (R)-2-amino-3-(methylsulfonyl)propanoic acid |
| THc = | (S)-2-amino-3-(2-hydroxyphenyl)propanoic acid |
| THd = | (S)-2-aminopent-4-enoic acid |
| THe = | (S)-2-amino-2-((R)-oxiran-2-yl)acetic acid |
| THf = | (S)-2-amino-2-(furan-2-yl)acetic acid |
| THg = | (S)-2-amino-2-((S)-morpholin-2-yl)acetic acid |
| THh = | (S)-2-amino-3-(dimethylamino)propanoic acid |
| THi = | (2R,3R)-2-amino-3-hydroxybutanoic acid |
| THj = | (R)-2-amino-2-(thiophen-2-yl)acetic acid |
| THk = | (S)-2-amino-3-morpholinopropanoic acid |
| THl = | (S)-2-amino-2-(pyridin-2-yl)acetic acid |
| PRa = | (S)-2,5-dihydro-1H-pyrrole-2-carboxylic acid |
| PRb = | (S)-piperidine-2-carboxylic acid |
| PRc = | (S)-azetidine-2-carboxylic acid |
| PRd = | (S)-azepane-2-carboxylic acid |
| PRe = | 2-(methylamino)acetic acid |
| PRf = | (S)-2-aminopropanoic acid |
| PRg = | 2-am ino-2-methylpropanoic acid |
| PRh = | 2-am ino-2,2-difluoroacetic acid |
| PRi = | (1S,9bS)-2,3,4,4a,5,9b-hexahydro-1H-pyrido [4,3-b]indole-1-carboxylic acid |
| PRj = | (S)-1,2,3,4-tetrahydroisoquinoline-3-carboxylic acid |
| PRk = | (S)-1,2-dihydroazete-2-carboxylic acid |
| PRl = | (S)-2,5-dihydro-1H-pyrrole-2-carboxylic acid |
| PRm = | (2S)-4-hydroxypyrrolidine-2-carboxylic acid |
| PRn = | (S)-5-thioxopyrrolidine-2-carboxylic acid |
| PRq = | (S)-thiazolidine-2-carboxylic acid |
| PRp = | (R)-5,5-dimethylthiazolidine-4-carboxylic acid |
| PHa = | (S)-2-amino-3-phenylpropanoic acid |
| PHb = | (S)-2-amino-3-(pyridin-4-yl)propanoic acid |
| PHc = | (S)-2-amino-3-(pyridin-3-yl)propanoic acid |
| PHd = | (S)-2-amino-3-(pyridin-2-yl)propanoic acid |
| PHq = | (S)-2-amino-3-(thiophen-2-yl)propanoic acid |
| PHf = | (S)-1,2,3,4-tetrahydroisoquinoline-3-carboxylic acid |
| PHg = | (S)-2-aminopent-4-ynoic acid |
| PHh = | (S)-2,4-diamino-4-iminobutanoic acid |
| PHi = | (S)-2-amino-4-methylpent-4-enoic acid |
| PHj = | (S)-2-amino-4-methylpentanoic acid |
| PHk = | (S)-2-amino-3-cyclopropylpropan-1-ol |
| PHl = | (S)-2-amino-2-phenylacetic acid |
| PHm = | (S)-2-amino-3-cyclohexylpropanoic acid |
| PHn = | (S)-2-amino-3-(piperidin-4-yl)propanoic acid |
| PHo = | (S)-2-aminohexanoic acid |
| PHp = | (S)-2-aminopent-4-enoic acid |

Additional Non-Natural Amino Acid Modifications

Figures and tables below contain additional non-natural amino acids that are useful substituents in STa peptide analogues of the present invention.

Figure 1:
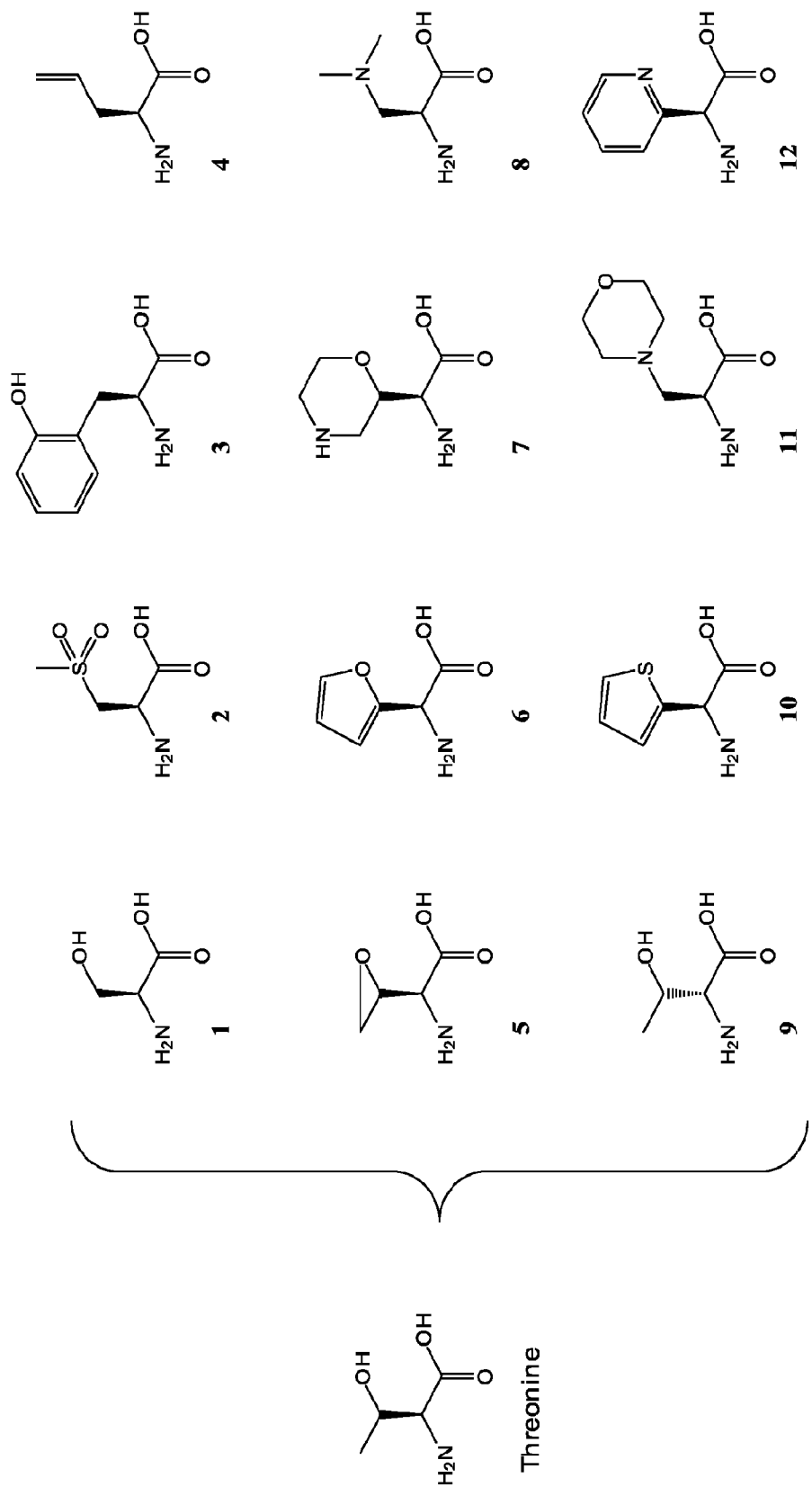
Figure 2:
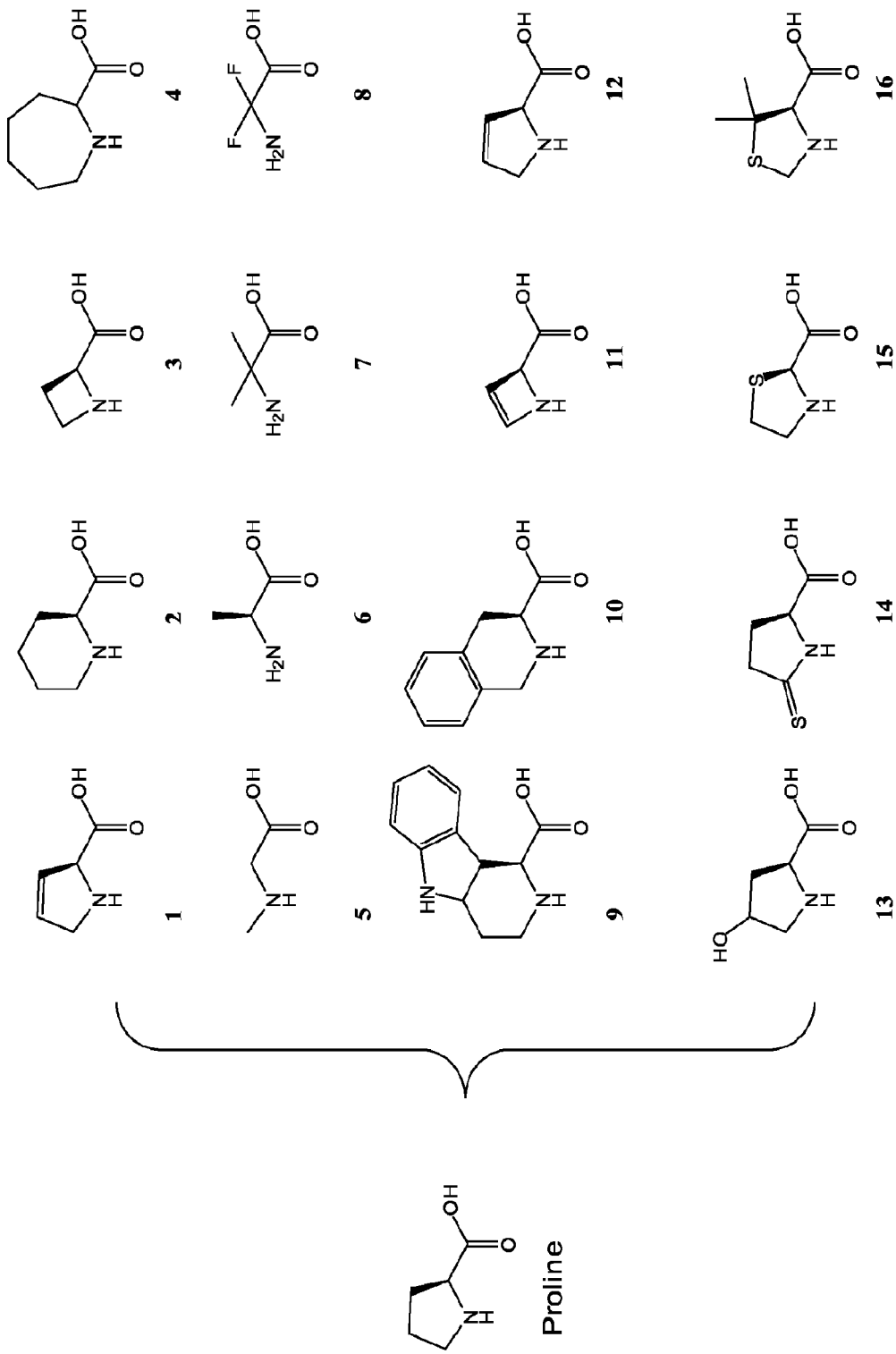
Figure 3:
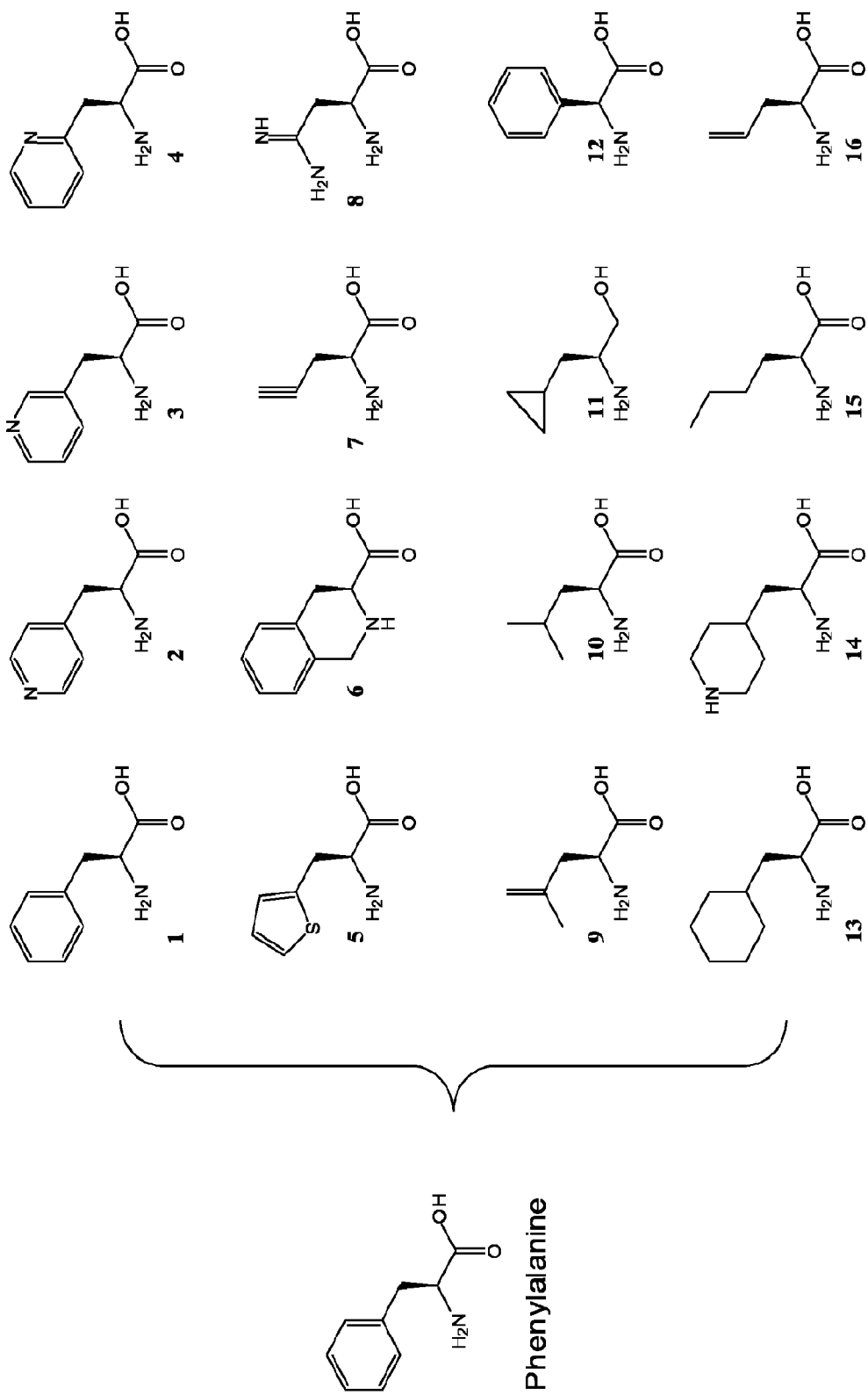

FIG. 1 illustrates non-natural analogues of threonine that are useful substituents in STa peptide analogues of the present invention, as further identified in Table 5.

TABLE 5

| Threonine analogues<br>Threonine analogue abbreviations in FIG 1. | | |
|---|---|---|
| 1 | THa | (S)-2-amino-3-hydroxypropanoic acid |
| 2 | THb | (R)-2-amino-3-(methylsulfonyl)propanoic acid |
| 3 | THc | (S)-2-amino-3-(2-hydroxyphenyl)propanoic acid |
| 4 | THd | (S)-2-aminopent-4-enoic acid |
| 5 | THe | (S)-2-amino-2-((R)-oxiran-2-yl)acetic acid |
| 6 | THf | (S)-2-amino-2-(furan-2-yl)acetic acid |
| 7 | THg | (S)-2-amino-2-((S)-morpholin-2-yl)acetic acid |
| 8 | THh | (S)-2-amino-3-(dimethylamino)propanoic acid |
| 9 | THi | (2R,3R)-2-amino-3-hydroxybutanoic acid |
| 10 | THj | (R)-2-amino-2-(thiophen-2-yl)acetic acid |
| 11 | THk | (S)-2-amino-3-morpholinopropanoic acid |
| 12 | THl | (S)-2-amino-2-(pyridin-2-yl)acetic acid |

FIG. 2 illustrates non-natural analogues of proline that are useful substituents in STa peptide analogues of the present invention, as further identified in Table 6.

TABLE 6

| Proline analogues<br>Proline analogue abbreviations in FIG 2. | | |
|---|---|---|
| 1 | PRa | (S)-2,5-dihydro-1H-pyrrole-2-carboxylic acid |
| 2 | PRb | (S)-piperidine-2-carboxylic acid |
| 3 | PRc | (S)-azetidine-2-carboxylic acid |
| 4 | PRd | (S)-azepane-2-carboxylic acid |
| 5 | PRe | 2-(methylamino)acetic acid |
| 6 | PRf | (S)-2-aminopropanoic acid |
| 7 | PRg | 2-amino-2-methylpropanoic acid |
| 8 | PRh | 2-amino-2,2-difluoroacetic acid |
| 9 | PRi | (1S,9bS)-2,3,4,4a,5,9b-hexahydro-1H-pyrido[4,3-b] indole-1-carboxylic acid |
| 10 | PRj | (S)-1,2,3,4-tetrahydroisoquinoline-3-carboxylic acid |
| 11 | PRk | (S)-1,2-dihydroazete-2-carboxylic acid |
| 12 | PRl | (S)-2,5-dihydro-1H-pyrrole-2-carboxylic acid |
| 13 | PRm | (2S)-4-hydroxypyrrolidine-2-carboxylic acid |
| 14 | PRn | (S)-5-thioxopyrrolidine-2-carboxylic acid |
| 15 | PRq | (S)-thiazolidine-2-carboxylic acid |
| 16 | PRp | (R)-5,5-dimethylthiazolidine-4-carboxylic acid |

FIG. 3 illustrates non-natural analogues of phenylalanine that are useful substituents in STa peptide analogues of the present invention, as further identified in Table 7.

TABLE 7

| Phenylalanine analogues<br>Phenylalanine analogue abbreviations in FIG 3. | | |
|---|---|---|
| 1 | PHa | (S)-2-amino-3-phenylpropanoic acid |
| 2 | PHb | (S)-2-amino-3-(pyridin-4-yl)propanoic acid |
| 3 | PHc | (S)-2-amino-3-(pyridin-3-yl)propanoic acid |
| 4 | PHd | (S)-2-amino-3-(pyridin-2-yl)propanoic acid |
| 5 | PHq | (S)-2-amino-3-(thiophen-2-yl)propanoic acid |
| 6 | PHf | (S)-1,2,3,4-tetrahydroisoquinoline-3-carboxylic acid |
| 7 | PHg | (S)-2-aminopent-4-ynoic acid |
| 8 | PHh | (S)-2,4-diamino-4-iminobutanoic acid |
| 9 | PHi | (S)-2-amino-4-methylpent-4-enoic acid |
| 10 | PHj | (S)-2-amino-4-methylpentanoic acid |
| 11 | PHk | (S)-2-amino-3-cyclopropylpropan-1-ol |
| 12 | PHl | (S)-2-amino-2-phenylacetic acid |
| 13 | PHm | (S)-2-amino-3-cyclohexylpropanoic acid |
| 14 | PHn | (S)-2-amino-3-(piperidin-4-yl)propanoic acid |
| 15 | PHo | (S)-2-aminohexanoic acid |
| 16 | PHp | (S)-2-aminopent-4-enoic acid |

Additional embodiments include but are not limited to those shown in the following Table 8A [and Table 8B?] showing single and double substitutions that may be used in the practice of the invention. One skilled in the art will appreciate that triple mutations comprising the various substitutions shown in the above schemes are also within the scope of the present invention. The embodiments shown in the tables are shown without the first four amino acids on the N-terminal and the C-terminal residue (residues 1-4 and 19 were left off). The amino acids shown in scheme 2 may be optionally included at these positions on the sequences shown in the tables.

TABLE 8A

Single mutations from Scheme 2, excluding sequences included in table 3A:

| | |
|---|---|
| SEQ ID NO: 2500 | Cys Cys Glu THa Cys Cys Asn Pro Ala Cys Ala Gly Cys Tyr |
| SEQ ID NO: 2501 | Cys Cys Glu THb Cys Cys Asn Pro Ala Cys Ala Gly Cys Tyr |
| SEQ ID NO: 2502 | Cys Cys Glu THc Cys Cys Asn Pro Ala Cys Ala Gly Cys Tyr |
| SEQ ID NO: 2503 | Cys Cys Glu THd Cys Cys Asn Pro Ala Cys Ala Gly Cys Tyr |
| SEQ ID NO: 2504 | Cys Cys Glu TRe Cys Cys Asn Pro Ala Cys Ala Gly Cys Tyr |
| SEQ ID NO: 2505 | Cys Cys Glu THE Cys Cys Asn Pro Ala Cys Ala Gly Cys Tyr |
| SEQ ID NO: 2506 | Cys Cys Glu THg Cys Cys Asn Pro Ala Cys Ala Gly Cys Tyr |
| SEQ ID NO: 2507 | Cys Cys Glu THh Cys Cys Asn Pro Ala Cys Ala Gly Cys Tyr |
| SEQ ID NO: 2508 | Cys Cys Glu THi Cys Cys Asn Pro Ala Cys Ala Gly Cys Tyr |
| SEQ ID NO: 2509 | Cys Cys Glu THj Cys Cys Asn Pro Ala Cys Ala Gly Cys Tyr |
| SEQ ID NO: 2510 | Cys Cys Glu THk Cys Cys Asn Pro Ala Cys Ala Gly Cys Tyr |
| SEQ ID NO: 2511 | Cys Cys Glu THl Cys Cys Asn Pro Ala Cys Ala Gly Cys Tyr |
| SEQ ID NO: 2512 | Cys Cys Glu Leu Cys Cys Asn PRa Ala Cys Ala Gly Cys Tyr |
| SEQ ID NO: 2513 | Cys Cys Glu Leu Cys Cys Asn PRb Ala Cys Ala Gly Cys Tyr |
| SEQ ID NO: 2514 | Cys Cys Glu Leu Cys Cys Asn PRc Ala Cys Ala Gly Cys Tyr |
| SEQ ID NO: 2515 | Cys Cys Glu Leu Cys Cys Asn PRd Ala Cys Ala Gly Cys Tyr |
| SEQ ID NO: 2516 | Cys Cys Glu Leu Cys Cys Asn PRe Ala Cys Ala Gly Cys Tyr |
| SEQ ID NO: 2517 | Cys Cys Glu Leu Cys Cys Asn PRf Ala Cys Ala Gly Cys Tyr |
| SEQ ID NO: 2518 | Cys Cys Glu Leu Cys Cys Asn PRg Ala Cys Ala Gly Cys Tyr |
| SEQ ID NO: 2519 | Cys Cys Glu Leu Cys Cys Asn PRh Ala Cys Ala Gly Cys Tyr |
| SEQ ID NO: 2520 | Cys Cys Glu Leu Cys Cys Asn PRi Ala Cys Ala Gly Cys Tyr |

TABLE 8A-continued

Single mutations from Scheme 2, excluding sequences included in table 3A:

| | |
|---|---|
| SEQ ID NO: 2521 | Cys Cys Glu Leu Cys Cys Asn PRj Ala Cys Ala Gly Cys Tyr |
| SEQ ID NO: 2522 | Cys Cys Glu Leu Cys Cys Asn PRk Ala Cys Ala Gly Cys Tyr |
| SEQ ID NO: 2523 | Cys Cys Glu Leu Cys Cys Asn PRl Ala Cys Ala Gly Cys Tyr |
| SEQ ID NO: 2524 | Cys Cys Glu Leu Cys Cys Asn PRm Ala Cys Ala Gly Cys Tyr |
| SEQ ID NO: 2525 | Cys Cys Glu Leu Cys Cys Asn PRn Ala Cys Ala Gly Cys Tyr |
| SEQ ID NO: 2526 | Cys Cys Glu Leu Cys Cys Asn PRq Ala Cys Ala Gly Cys Tyr |
| SEQ ID NO: 2527 | Cys Cys Glu Leu Cys Cys Asn PRp Ala Cys Ala Gly Cys Tyr |
| SEQ ID NO: 2528 | Cys Cys Glu Leu Cys Cys Asn Pro Ala Cys PHa Gly Cys Tyr |
| SEQ ID NO: 2529 | Cys Cys Glu Leu Cys Cys Asn Pro Ala Cys PHb Gly Cys Tyr |
| SEQ ID NO: 2530 | Cys Cys Glu Leu Cys Cys Asn Pro Ala Cys PHc Gly Cys Tyr |
| SEQ ID NO: 2531 | Cys Cys Glu Leu Cys Cys Asn Pro Ala Cys PHd Gly Cys Tyr |
| SEQ ID NO: 2532 | Cys Cys Glu Leu Cys Cys Asn Pro Ala Cys PHq Gly Cys Tyr |
| SEQ ID NO: 2533 | Cys Cys Glu Leu Cys Cys Asn Pro Ala Cys PHf Gly Cys Tyr |
| SEQ ID NO: 2534 | Cys Cys Glu Leu Cys Cys Asn Pro Ala Cys PHg Gly Cys Tyr |
| SEQ ID NO: 2535 | Cys Cys Glu Leu Cys Cys Asn Pro Ala Cys PHh Gly Cys Tyr |
| SEQ ID NO: 2536 | Cys Cys Glu Leu Cys Cys Asn Pro Ala Cys PHi Gly Cys Tyr |
| SEQ ID NO: 2537 | Cys Cys Glu Leu Cys Cys Asn Pro Ala Cys PHj Gly Cys Tyr |
| SEQ ID NO: 2538 | Cys Cys Glu Leu Cys Cys Asn Pro Ala Cys PHk Gly Cys Tyr |
| SEQ ID NO: 2539 | Cys Cys Glu Leu Cys Cys Asn Pro Ala Cys PHl Gly Cys Tyr |
| SEQ ID NO: 2540 | Cys Cys Glu Leu Cys Cys Asn Pro Ala Cys PHm Gly Cys Tyr |
| SEQ ID NO: 2541 | Cys Cys Glu Leu Cys Cys Asn Pro Ala Cys PHn Gly Cys Tyr |
| SEQ ID NO: 2542 | Cys Cys Glu Leu Cys Cys Asn Pro Ala Cys PHo Gly Cys Tyr |
| SEQ ID NO: 2543 | Cys Cys Glu Leu Cys Cys Asn Pro Ala Cys PHp Gly Cys Tyr |

Modifications of the Peptides

In addition to the above specified peptides, one or more amino acids of the GCC peptides can be replaced by other amino acid that are not among the naturally occurring. For example, an aromatic amino acid can be replaced by 3,4-dihydroxy-L-phenylalanine, 3-iodo-L-tyrosine, triiodothyronine, L-thyroxine, phenylglycine or nor-tyrosine. Phenylglycine, nor-tyrosine, phenylalanine, tyrosine and other amino acids can be substituted by, e.g., a halogen, —CH3, —OH, —CH2NH3, —C(O)H, —CH2CH3, —CN, —CH2CH2CH3, —SH, or another group. Any amino acid can be substituted by the D-form of the amino acid. Alanine can be substituted with alpha-substituted or N-methylated amino acid such as alpha-amino isobutyric acid, LI D-alpha-ethylalanine, LID-methylvaline, or LID-alpha-methylleucine. Glutamine can be substituted with gamma-Hydroxy-Glu or gamma-Carboxy-Glu. Glycine can be substituted with alpha-amino isobutyric acid or LID-alpha-ethylalanine. Proline can be substituted with homoproline (L-pipecolic acid), hydroxy-Proline, 3,4-Dehydro-Proline, 4-fluoroproline or alpha-methyl-Proline. Tyrosine (Tyr) can be substituted with an alpha substituted amino acid such as L-alpha-methylphenylalanine or by other analogues such as A-MethylTrp, tBu-Gly, 3-Amino-Tyr, 5-Methyl-Trp, Amino-Phe, beta-(1-Cyclopentenyl)Ala, beta-(2-Pyridyl)-Ala, beta-(2-Thiazolyl)-Ala, beta-(2-thienyl)-Ala, beta-(3-benzothienyl)-Ala, beta-(3-Pyridyl)-Ala, beta-(Triazole-1-yl)Ala, beta-Cyclohexyl-Ala, beta-Cyclopentyl-Ala, beta-Cyclopropyl-Ala, betaQuinolyl-Ala, Cyclohexyl-Gly, and Fluoro-Phe.

Other examples include amino acids substituted with an alkyl, aryl, acyl, azido, borate, boronate, cyano, halo, hydrazine, hydrazide, hydroxyl, alkenyl, alkynl, ether, ester, sulfonyl, seleno, thiol, thioacid, phospho, phosphono, phosphine, enone, imine, aldehyde or hydroxylamine. Other examples are amino acid with a radioactive amino acid, a spin-labeled amino acid, an amino acid with a photo-activatable cross-linker, 3-methyl-phenylalanine, 4-propyl-L-tyrosine, a disubstituted amino acid, a keto containing amino acid, a metal binding amino acid, p-iodo-phenylalanine, amino acids comprising polyethylene glycol or polyether, amino-isobutyric acid, an amino thio amino acid, isopropyl-L-phenylalanine, L-Dopa, nitro-arginine, norleucine, O-methyl-L-tyrosine, phosphonoserine, 3-nitro-tyrosine, 4-fluorophenylglycine, a biotin or biotin-analogue containing amino acid, a cyclic amino acid other than proline, a fluorinated phenylalanine, a glycosylated amino acid, a heavy atom substituted amino acid including an amino acid containing deuterium, a carbohydrate modified amino acid, p-(propargyloxy)-phenylalanine, a p-acetyl-L-phenylalanine, a p-acyl-L-phenylalanine, a redox-active amino acid, acetamidomethyl protected amino acids, aminobutyric acid, aminohexanoic acid, an amino acid containing a toxic group; a sugar substituted amino acid, Carbobenzoxyl, citrulline, cyclohexylalanine, D-3-(2-naphthyl)alanine, d-cyclohexylalanine, dimethyl-Lysine, E-Acetyl-Lysine, hydroxyproline, isopropyl-L-phenylalanine, L-3-(2-naphthyl)alanine, L-3-(2-naphthyl)alanine, L-phosphoserine, mercaptopropionic acid, methyl-lysine, nitrophenylalanine, nitro-tyrosine, norvaline, octahydroindole carboxylate, O-methyl-L-tyrosine, O-allyl ornithine, p-amino-L-phenylalanine, p-azido-L-phenylalanine, p-benzoyl-L-phenylalanine, p-bromophenylalanine, pegylated amino acids, penicillamine, isopropyl-phosphonotyrosine, pyro-glutamic acid, tetrahydroisoquinoline, tritium containing amino acids, or a fluorescent amino acid.

Further examples of unnatural amino acids and amino acid analogs can be found in (Schultz et al., 2002—US. 20030082575; Alfonta et al., 2010—U.S. Pat. No. 7,811,801; Cho et al., 2006—US20060019347; Shailubhai & Gary, 2009—US20090048175) and the references therein.

The GCC peptides can also be cyclic peptides. Cyclic peptide can be made through methods known in the art. For example, macrocyclization can be accomplished by forming an amide bond between the peptide N- and C-termini, or between a side chain and the N- or C-terminus, or between two amino acid side chains such as cysteine. The GCC peptides can also be bicyclic.

The disulphide bonds in the GCC peptides can also be modified. In some GCC peptides one or more members of one, two or all pairs of the cysteine residues which normally form a disulfide bond can be replaced by alternate residues, such as homocysteine, penicillamine, 3-mercaptoproline, dimethylcysteine or diaminopropionic acid to form alternative internal bridges at the positions of the normal disulfide bonds. One or more of the disulfide bonds can be replaced by alternative covalent cross-links, such as an amide linkage, an amine linkage, an alkenyl linkage, an alkyl linkage, a carbamoyl linkage, an ester linkage, a thioester linkage, a lactam linkage, a urea linkage, a thiourea linkage, a phosphonate ester linkage, an ether linkage, a thioether linkage, or a thioamide linkage.

The GCC peptides can have one or more of the polypeptide bonds replaced by an alternative bond. Such bonds may increase the peptide's activity or increase its stability by reducing cleavage by reductases, proteases or carboxy peptidases. Examples of bonds that can replace conventional polypeptide bonds include a reduced amide bond, an ethylene bond, a fluoro substituted trans-olefine bond, a fluoro-ketomethylene bond, a ketomethylene bond, a retro-inverso bond (a C(O)—NH instead of NH—C(O)), an oxomethylene bond, a thiomethylene bond, a thioamide bond, and a trans-olefine bond.

The GCC peptides can be modified by one or more modifications or one or more types of modification. Modifications may occur at the amino terminus, at the carboxy terminus, internally or a combination of any these. Non-limiting examples of are modifications by acetylation, amidation, 7-Amino-4-methyl-coumarin, amide cyclisation, biotinylation, cinnamoylation, cyclisation, disulfide bridges cyclisation, Cys3, Cys5, dabcyl, dabsyl, dansyl, farnesylation, FMOC, formylation, myristoylation, palmitoylation, phosphorylation, stearoylation, succinylation, sulfurylation, 2,4-dinitrophenyl, dinitrophenyl-lysine, flourescein, 7-Nitrobenz-2-oxa-1,3-Diazole, p-nitro-anilide, rhodamine B, 5-((2-aminoethyl)amino)naphthalene-1-sulfonic acid, texas red, and tetramethylrhodamine.

The GCC peptides can also be conjugated. Non-limiting examples of conjugation include polyethylene glycol (PEG), Bovine Serum Albumine, Human Albumine, alkyl groups, C1 to C40 straight or branched alkyl groups, fatty acid radicals, Keyhole Limpet Hemocyanin, and combinations of any of the before mentioned conjugations (Ekwuribe et al., 2001—U.S. Pat. No. 6,309,633; Soltero & Ekwuribe 2001; Payne & Manning, 2009; Currie & Sterling 2010-US2006019347).

The GCC peptides can also be modified in different ways, as long as they retain most of the GCC receptor agonist potency or apoptosis inducing potency of the naturally occurring peptides, or more. The GCC peptides can also include versions which are modified or hybrid forms, in which some amino acids have been changed, replaced or deleted. This includes modifications such as glycosylation.

The GCC peptides include peptides where amino acid substitutions have been made at one or more non-essential amino acids. These are substitutions where the amino acids have been replaced with an amino acid that has a similar side chain. Groups of such amino acids include amino acids with acidic side chains (aspartic acid, glutamic acid), aromatic side chains (tyrosine, phenylalanine, tryptophan, histidine), basic side chains (lysine, arginine, histidine), branched side chains (threonine, valine, isoleucine), nonpolar side chains (alanine, valine, leucine, isoleucine, proline, phenylalanine, methionine, tryptophan) and uncharged polar side chains (glycine, asparagine, glutamine, serine, threonine, tyrosine, cysteine). In such substitutions, the non-essential amino acid is replaced with another amino acid from the same group, or randomly substituted along the GCC peptide.

Preparation of the Peptides

GCC peptides can be produced by various methods. For example, they can be prepared using recombinant cloning techniques, or synthesized de novo by chemical protocols, or by site-directed mutagenesis. Chemical synthesis may generally be performed using standard solution phase or solid phase peptide synthesis techniques, in which a peptide linkage occurs through the direct condensation of the amino group of one amino acid with the carboxy group of the other amino acid and the elimination of a water molecule. Such peptide bond synthesis usually requires suppression of reactive groups of both amino acids (US 2010/0093635 Al; Gongora-Benitez et al., 2010).

In the case of solution phase synthesis, a wide variety of coupling methods and protecting groups may be used (See, Gross and Meienhofer, eds., "The Peptides: Analysis, Synthesis, Biology," Vol. 1-4 (Academic Press, 1979); Bodansky and Bodansky, "The Practice of Peptide Synthesis," 2d ed. (Springer Verlag, 1994)).

In the case of solid phase peptide synthesis, an insoluble polymer is used for support during organic synthesis, permitting the use of simple washing and filtration steps. Solid-phase peptide synthesis can, for example, be performed according to the method of Merrifield et al., J. Am. Chem. Soc., 1963, 85:2149 involving assembling a linear peptide chain on a resin support using protected amino acids. Solid phase synthesis typically utilizes either the Boc or Fmoc strategy, which are well known in the art. Here, de-protection and coupling reactions must go to completion and the side-chain blocking groups must be stable throughout the synthesis. Typically, solid phase synthesis is more suitable when peptides are made on a small scale. Acetylation of the N-terminal can be achieved by reacting the last peptide with acetic anhydride before cleavage from the resin. C-amidation is carried out using an appropriate resin such as methylbenzhydrylamine resin using the Boc technology.

Mature peptides and variants thereof can also be synthesized on Cyc(4-CH2 Bxl)—OCH2-4-(oxymethyl)-phenylacetamidomethyl resin using a double coupling program. Protecting groups must be used appropriately to create the correct disulfide bond pattern. The resulting peptide is then purified by reverse-phase chromatography. Peptides can also be synthesized by many other methods including solid phase synthesis using traditional FMOC protection (i.e., coupling with DCC-HOBt and de-protection with piperidine in DMF). Cys thiol groups can be trityl protected. Treatment with TFA can be used for final de-protection of the peptide and release of the peptide from the solid-state resin. In many cases air oxidation is sufficient to achieve proper disulfide bond formation.

Alternatively, immature or mature forms of GCC peptides—consisting entirely of standard amino acids, or of standard amino acids that are easily derivatized—may be produced by recombinant cloning techniques in bacterial, baculovirus, yeast, fungal or mammalian cell expression systems.

Formulation of the Peptides

GCC peptides can be administered alone or in combination with other agents such as inhibitors of cGMP dependent phosphodiesterase, such as, for example, motapizone sulindac sulfone, zaprinast, vardenafil or sildenafil; chemotherapeutic agents; or anti-inflammatory drugs like steroids or non-steroidal anti-inflammatory drugs such as aspirin, antiviral agents, or anti-cancer agents. Combination treatment is achieved by administering two or more agents formulated and administered separately or in a single formulation, or formulated together and administered in conjunction with a formulation containing a third agent. Combination therapy can be applied simultaneously or at different times. For example, two or more agents can be administered within minutes of each other or within 1, 2, 3, 4, 6, 9, 12, 18, or 24 hours of each other or within 1, 2, 3, 4, 5, 6, 7, 8, 9, 10, 12, or 14 days of each other or within 1, 2, 3, 4, 5, 6, 7, 8, 9, or 10 weeks of each other. Even shorter or longer intervals are possible.

The GCC peptides described herein may be combined with phosphodiesterase inhibitors, e.g., motapizone, sulindae sulfone, zaprinast, sildenafil, vardenafil or tadalafil to further or with azathioprine and/or other immunomodulating agents. The immunomodulating agents may include small molecule drugs and biologics such as Remicade, Humira, Cimzia etc.

Other agents that may be combined with GCC peptides described herein are cisdapride, Cimetropium, dolasetron, trimebutine maleate, diciclomine, cholestyramine, darifenacin, Calcium polycarbophil, ondansetron, tegaserod, hysvyamine sulfate, pinaverium bromide, mebeverine, granisetron, propanthiline bromide, alosetron hydrochloride, rifaximin, bumetanide. GCC peptides may also be used in combination with agents to treat gastrointestinal cancers, Crohn's Disease, Ulcerative Colitis, Constipation, Irritable Bowel Syndrome, postoperative Ileus, including phosphodiesterase inhibitors, analgesic agents, anti-viral agents, anti-cancer agents, anti-inflammatory agents, and anti-obesity agents. Agent combination therapy may also be administered via different routes or locations, e.g. one orally, another intravenously or locally.

Approximated dosages for some of the combination therapy agents described herein are found in the "BNF Recommended Dose" column of tables on pages 11-17 of WOO 11 76632 and can also be found in other standard formularies and other drug prescribing directories. For some drugs, the customary prescribed dose will vary from country to country.

GCC peptides, alone or in combination, can be added to any common pharmaceutical carrier or medium and can thus be combined with materials that do not produce an adverse, allergic or otherwise unwanted reaction in a patient. Such carriers or mediums include solvents, coatings, dispersants, absorption promoting agents, controlled release agents, and one or more inert excipients (which include starches, polyols, granulating agents, microcrystalline cellulose, diluents, lubricants, binders, disintegrating agents, and similar), etc. If desired, tablet or capsule dosages of the disclosed compositions may be coated by standard aqueous or nonaqueous techniques. It is to be understood that a pharmaceutical composition of the invention is formulated to be compatible with its intended route of administration. Examples of routes of administration are parenteral, e.g., intravenous, intradermal, subcutaneous, oral, inhalation, transdermal, topical, transmucosal, and rectal. Solutions or suspensions used for parenteral, intradermal, or subcutaneous application can include for example: a sterile diluent such as water for injection, saline solution, oils, glycerine, polyethylene glycols, propylene glycol or other synthetic solvents; antibacterial agents such as benzyl alcohol; antioxidants such as ascorbic acid; chelating agents such as ethylenediaminetetraacetic acid; buffers such as acetates, citrates or phosphates, and agents for the adjustment of tonicity such as sodium chloride, sucrose or dextrose. The pH can be adjusted with acids or bases.

Pharmaceutical compositions suitable for injectable use include sterile aqueous solutions or dispersions and sterile powders for the preparation of sterile injectable solutions or dispersions. For intravenous administration, suitable carriers include physiological saline, bacteriostatic water, or phosphate buffered saline (PBS). The carrier can be a solvent or dispersion medium containing, for example, water, ethanol, polyols (for example, glycerol, propylene glycol and the similar), and mixtures thereof. The proper fluidity of the dispersion can be reached, for example, by the use of a coating such as lecithin, by the appropriate particle size in the case of dispersion and by the use of surfactants. Prevention if growth of microrganisms can be achieved by various antibacterial and antifungal agents such as parabens, chlorobutanol, ascorbic acid, thimerosal, and the like. In some cases, inclusion of isotonic agents will be required, for example, sugars, polyalcohols such as manitol, sorbitol or sodium chloride. Delayed or prolonged absorption of the agent or combination of agents can be achieved by including an compositions which delays absorption, such as aluminum monostearate and gelatin.

Sterile solutions for injection can be prepared by mixing the active compound with an appropriate solvent with one or a combination of ingredients, as required, followed by filtered sterilization. Typically, dispersions are prepared by incorporating the active compound into a sterile vehicle containing a basic dispersion medium and the required other ingredient. For sterile powders for the preparation of sterile injectable solutions, methods of preparation are vacuum drying and freeze-drying that yields a powder of the active ingredient plus any additional desired ingredient from a sterile solution thereof.

Oral route compositions typically include an inert diluent or carrier like mannitol, fructooligosaccharides, polyethylene glycol along with other excipients, which can be enclosed in capsules or compressed into tablets. For oral therapeutic administration, the active compound can be incorporated with excipients and used in the form of tablets, capsules or troches. Oral route compositions can also be prepared using a fluid carrier wherein the compound in the fluid carrier is applied orally and expectorated or swallowed. Pharmaceutically compatible binding agents and materials can be included in the composition. It can contain any of the following or similar components: binders such as microcrystalline cellulose, gum tragacanth or gelatin; excipients such as starch or lactose, a disintegrating agents such as alginic acid or corn starch; lubricants such as magnesium stearate; glidants such as colloidal silicon dioxide; a weting agents such as sucrose or saccharin; flavoring agents such as peppermint or orange flavoring.

For inhalation, the agents can be delivered in the form of an aerosol spray from container or dispenser, which contains a suitable propellant, e.g., a gas such as carbon dioxide, or from a nebulizer.

Systemic administration can for example be by transmucosal or transdermal means. For transmucosal or transdermal administration, appropriate penetrant enhancers are used in the formulation. These are generally known in the art, and include, for example, detergents and bile salts. Transmucosal administration can be achieved through use of nasal sprays or suppositories. For transdermal administration, the active compounds may be formulated into ointments, salves, gels, or creams as generally known in the art. The agents may also be prepared in the form of suppositories with conventional suppository bases such as cocoa butter and other glycerides, or as retention enemas for rectal delivery.

In another embodiment, the active agents are combined with carriers that will prevent the compound from being rapid eliminated from the body. Such delayed or controlled release formulation may include implants, microencapsulated delivery systems, biodegradable polymers (such as polyanhydrides, polyglycolic acid, collagen and polyorthoesters). Methods for preparation of these compositions are well known to those skilled in the art. Liposomal suspensions can also be used as pharmaceutically acceptable carriers, according to methods known to those skilled in the art (see, for example U.S. Pat. No. 4,522,811).

An oral or parenteral compositions in dosage unit form can be formulated and packaged for ease of administration and uniformity of dosage. The pharmaceutical compositions can be included in a container, pack, or dispenser together with instructions for administration.

Formulations of the present invention may also include other therapeutic ingredients and non-active ingredients, such as anti-caking agents, preservatives, sweetening agents, colorants, flavors, desiccants, plasticizers, dyes, glidants, anti-adherents, antistatic agents, surfactants, anti-oxidants and the like. The formulation may also contain other additives as needed, including for example lactose, glucose, fructose, galactose, sucrose, maltose, mannitol, myoinositol, raffnose, maltitol, stachyose, lactitol, palatinite, starch, xylitol, and the like, and hydrates thereof, and amino acids, for example alanine, glycine, and polypeptides and proteins, for example albumen.

Many types of substances can be used as pharmaceutically acceptable excipients. Non-binding examples include binders, fillers, disintegrants, lubricants, antimicrobial agents, and coating agents such as: BINDERS: corn starch, potato starch, other starches, gelatin, natural and synthetic gums, xanthan, sodium alginate, alginates, guar gum, cellulose and cellulose derivatives, e.g., ethyl cellulose, cellulose acetate, carboxymethyl cellulose calcium, polyvinyl pyrrolidones, e.g., povidone, crospovidone, copovidone, methyl cellulose, pre-gelatinized starch, microcrystalline cellulose, or mixtures thereof; FILLERS: talc, calcium carbonate, dibasic or tribasic calcium phosphate, calcium sulfate, microcrystalline cellulose, dextrates, mannitol, silicic acid, sorbitol, starch, dextrose, fructose, lactose anhydrate, lactose, aspartame, maltose, mannitol, microcrystalline cellulose & amp; guar gum, sucrose, or mixtures thereof; DISINTEGRANTS: agar, alginic acid, calcium carbonate, microcrystalline cellulose, polacrilin potassium, tapioca starch, pregelatinized starch, clays, gums; LUBRICANTS: calcium stearate, magnesium stearate, mineral oil, glycerin, sorbitol, mannitol, polyethylene glycol, stearic acid, sodium stearyl fumarate, talc, hydrogenated vegetable oil, zinc stearate, syloid silica gel or mixtures thereof; ANTI-CAKING AGENTS: calcium silicate, magnesium silicate, colloidal silicon dioxide, talc, or mixtures thereof; ANTIMICROBIAL AGENTS: benzalkonium chloride, benzethonium chloride, benzoic acid, benzyl alcohol, cetylpyridinium chloride, cresol, ethylparaben, methylparaben, phenol, phenylethyl alcohol, phenoxyethanol, phenylmercuric acetate, phenylmercuric nitrate, sodium dehydroacetate, sodium propionate, sorbic acid, thimersol, thymo, or mixtures thereof; COATING AGENTS: sodium carboxymethyl cellulose, ethylcellulose, gelatin, hydroxypropyl cellulose, hydroxypropyl methylcellulose, hydroxypropyl methyl cellulose phthalate, methylcellulose, polyethylene glycol, sucrose, titanium dioxide, carnauba wax, microcrystalline wax, gellan gum, maltodextrin, methacrylates, microcrystalline cellulose, or mixtures thereof.

The formulation may also include other excipients including but not limited to L-histidine, Pluronic, Poloxamers (such as Lutrol and Poloxamer 188), ascorbic acid, glutathione, permeability enhancers (e.g. lipids, sodium cholate, salicylates, mixed bile salts, fatty acid micelles, chelators), protease inhibitors (e.g. trypsin inhibitors, organic acids), pH lowering agents and absorption enhancers (see for example U.S. Pat. No. 6,086,918 and U.S. Pat. No. 5,912,014), creams and lotions; materials for chewable tablets (like dextrose, fructose, maltodextrin, maltose, mannitol, guar gum, sorbitol crystalline); parenterals (like mannitol and povidone); plasticizers (like dibutyl sebacate, polyvinylacetate phthalate); powder lubricants (like glyceryl behenate); soft gelatin capsules; spheres for coating; spheronization agents (like microcrystalline cellulose); suspending/gelling agents (like gellan gum, mannitol, microcrystalline cellulose, povidone, sodium starch); sweeteners (like aspartame, aspartame and lactose, dextrose, fructose, maltodextrin, maltose, mannitol, sucrose); wet granulation agents (like calcium carbonate, lactose anhydrous, lactose monohydrate, maltodextrin, mannitol), caramel, carboxymethylcellulose sodium, flavoring agents, citric acid, confectioner's sugar, disodium edetate, FD&C Yellow No. 6 aluminum lake, FD&C Blue No. 1, FD&C blue no. 2 aluminum lake, glycerol palmitostearate, glyceryl monostearate, orange flavor, strawberry flavor, synthetic black iron oxide, synthetic red iron oxide and titanium dioxide.

Formulations for oral dosage may also be treated with coating systems to create a sustained release formulation, for example Opadry blue (OY-LS-20921) and Opadry white (YS-2-7063). Compounds either in their free form or as a salt can be combined with a polymers such as poly-(1)-lactic-glycolic-tartaric acid, polyglycolic acid and poly alkylene oxide (U.S. 20030068384). Such formulations can be used within implants that releases a the agent over a period of a few days, a few weeks or several months. Other examples of sustained release formulations and polymers are described in WO 97/40085, WO 03/075887, WO 93/24150, U.S. Pat. No. 5,612,052, WO 01101964A2, U.S. Pat. No. 5,922,356, WO 941155587, WO 02/074247A2, WO 98/25642, U.S. Pat. No. 5,968,895, U.S. Pat. No. 6,180,608, U.S. 20030171296. U.S. Pat. No. 5,192,741, U.S. Pat. No. 5,192,741, U.S. Pat. No. 4,668,506, U.S. 20020176841, U.S. Pat. No. 5,672,659, U.S. Pat. No. 5,893,985, U.S. Pat. No. 5,134,122, U.S. Pat. No. 4,713,244, and US20020019446. One or more sustained release implants can be placed in the stomach, the large intestine, the small intestine or both. Examples controlled release formulations are described in U.S. 20030138488A1, U.S. 20030216307 Al, U.S. Pat. No. 6,667,060, WO 01/49249, WO02/38129, EP 326151, U.S. Pat. No. 5,236,704, WO 02/30398, WO 98/13029; U.S. 20030064105 and WO 01149311. Example materials, which may be included are described in WO04041195. pH-sensitive coatings that achieve delivery in the colon includes those described in U.S. Pat. No. 4,910,021 and WO9001329 U.S. Pat. No. 4,910,021, WO9001329 and U.S. Pat. No. 5,175,003.

The GCC peptides described herein can be formulated in a pH triggered targeted control release systems such as described in WO04052339 or according to the methodology described in WO03105812, WO02072075, WO05063156, WO0243767, WO03007913, WO03086297, WO04064769, WO03035029, WO03035041,U.S. Pat. No. 5,007,790, U.S. Pat. No. 5,972,389, WO05027878, WO02072033, WO02072034, WO05030182, WO05048998, U.S. Pat. No. 5,108,758, U.S. Pat. No. 5,952,314, U.S. Pat. No. 5,840,860, U.S. Pat. No. 5,866,619, U.S. Pat. No. 6,368,629, U.S. Pat. No. 6,531,152, U.S. Pat. No. 6,234,464; U.S. Pat. No. 6,403,130, WO0174 175 and WO040 19872.

The GCC peptides described herein may be formulated using a gastrointestinal retention system technology such as GIRES (Merrion Pharmaceuticals). GIRES comprises a controlled-release dosage form inside an inflatable pouch, which is placed in a drug capsule for oral administration. Upon dissolution of the capsule, a gas-generating system inflates the pouch in the stomach where it is retained for 16-24 hours, all the time releasing agents.

GCC peptides can also be formulated using an osmotic device as those disclosed in U.S. Pat. No. 4,503,030, U.S. Pat. No. 5,609,590 and U.S. Pat. No. 5,358,502 and U.S. Pat. No. 4,503,030. The GCC peptide can also be formulated in an osmotic bursting device as described in U.S. Pat. Nos. 5,609, 590 and 5,358,502.

Dosage of the Peptides

The dose range of administered agent for adult humans is generally from 0.005 mg to 10 g/day. A dosage unit (e.g. an oral dosage unit) can include from, for example, 1 to 30 ug, 1 to 40 ug, 1 to 50 ug, 1 to 100 ug, 1 to 200 ug, 1 to 300 ug, 1 to 400 ug, 1 to 500 ug, 1 to 600 ug, 1 to 700 ug, 1 to 800 ug, 1 to 900 ug, 1 to 1000 ug, 10 to 30 ug, 10 to 40 ug, 10 to 50 ug, 10 to 100 ug, 10 to 200 ug, 10 to 300 ug, 10 to 400 ug, 10 to 500 ug, 10 to 600 ug, 10 to 700 ug, 10 to 800 ug, 10 to 900 ug, 10 to 1000 ug, 100 to 200 ug, 100 to 300 ug, 100 to 400 ug, 100 to 500 ug; 100 to 600 ug, 100 to 700 ug, 100 to 800 ug, 100 to 900 ug, 100 to 1000 ug, 100 to 1250 ug, 100 to 1500 ug, 100 to 1750 ug, 100 to 2000 ug, 100 to 2250 ug, 100 to 2500 ug, 100 to 2750 ug, 100 to 3000 ug, 200 to 300 ug, 200 to 400 ug, 200 to 500 ug, 200 to 600 ug, 200 to 700 ug, 200 to 800 ug, 200 to 900 ug, 200 to 1000 ug, 200 to 1250 ug, 200 to 1500 ug, 200 to 1750 ug, 200 to 2000 ug, 200 to 2250 ug, 200 to 2500 ug, 200 to 2750 ug, 200 to 3000 ug, 300 to 400 ug, 300 to 500 ug, 300 to 600 ug, 300 to 700 ug, 300 to 800 ug, 300 to 900 ug, 300 to 1000 ug, 300 to 1250 ug, 300 to 1500 ug, 300 to 1750 ug, 300 to 2000 ug, 300 to 2250 ug, 300 to 2500 ug, 300 to 2750 ug, 300 to 3000 ug, 400 to 500 ug, 400 to 600 ug, 400 to 700 ug, 400 to 800 ug, 400 to 900 ug, 400 to 1000 ug, 400 to 1250 ug, 400 to 1500 ug, 400 to 1750 ug, 400 to 2000 ug, 400 to 2250 ug, 400 to 2500 ug, 400 to 2750 ug, 400 to 3000 ug, 500 to 600 ug, 500 to 700 ug, 500 to 800 ug, 500 to 900 ug, 500 to 1000 ug, 500 to 1250 ug, 500 to 1500 ug, 500 to 1750 ug, 500 to 2000 ug, 500 to 2250 ug, 500 to 2500 ug, 500 to 2750 ug, 500 to 3000 ug, 600 to 700 ug, 600 to 800 ug, 600 to 900 ug, 600 to 1000 ug, 600 to 1250 ug, 600 to 1500 ug, 600 to 1750 ug, 600 to 2000 ug, 600 to 2250 ug, 600 to 2500 ug, 600 to 2750 ug, 600 to 3000 ug, 700 to 800 ug, 700 to 900 ug, 700 to 1000 ug, 700 to 1250 ug, 700 to 1500 ug, 700 to 1750 ug, 700 to 2000 ug, 700 to 2250 ug, 700 to 2500 ug, 700 to 2750 ug, 700 to 3000 ug, 800 to 900 ug, 800 to 1000 ug, 800 to 1250 ug, 800 to 1500 ug, 800 to 1750 ug, 800 to 2000 ug, 800 to 2250 ug, 800 to 2500 ug, 800 to 2750 ug, 800 to 3000 ug, 900 to 1000 ug, 900 to 1250 ug, 900 to 1500 ug, 900 to 1750 ug, 900 to 2000 ug, 900 to 2250 ug, 900 to 2500 ug, 900 to 2750 ug, 900 to 3000 ug, 1000 to 1250 ug, 1000 to 1500 ug, 1000 to 1750 ug, 1000 to 2000 ug, 1000 to 2250 ug, 1000 to 2500 ug, 1000 to 2750 ug, 1000 to 3000 ug, 2 to 500 ug, 50 to 500 ug, 3 to 100 ug, 5 to 20 ug, 5 to 1100 ug, 10 ug, 20 ug, 30 ug, 40 ug, 50 ug, 60 ug, 70 ug, 75 ug, 80 ug, 90 ug, 100 ug, 150 ug, 200 ug, 250 ug, 300 ug, 350 ug, 400 ug, 450 ug, 500 ug, 550 ug, 600 ug, 650 ug, 700 ug, 750 ug, 800 ug, 850 ug, 900 ug, 950 ug, 1000 ug, 1050 ug, 1100 ug, 1150 ug, 1200 ug, 1250 ug, 1300 ug, 1350 ug, 1400 ug, 1450 ug, 1500 ug, 1550 ug, 1600 ug, 1650 ug, 1700 ug, 1750 ug, 1800 ug, 1850 ug, 1900 ug, 1950 ug, 2000 ug, 2050 ug, 2100 ug, 2150 ug, 2200 ug, 2250 ug, 2300 ug, 2350 ug, 2400 ug, 2450 ug, 2500 ug, 2550 ug, 2600 ug, 2650 ug, 2700 ug, 2750 ug, 2800 ug, 2850 ug, 2900 ug, 2950 ug, 3000 ug, 3250 ug, 3500 ug, 3750 ug, 4000 ug, 4250 ug, 4500 ug, 4750 ug, 5000 ug of a peptide described herein.

Ileal and Colonic Site of Action in Accordance with the Present Invention

According to the present invention, it has been surprisingly discovered that ileal and colonic release formulations of the invention have therapeutic potential for treating a number of clinical conditions including, for example, the treatment of constipation, irritable bowel syndrome, a wide variety of inflammatory conditions, and as anti-metastatic agents in the treatment of cancer. In particular, the invention has discovered therapeutic advantages for releasing a secretagouge such as a GCCR agonist peptide in the distal jejunum, ileum, cecum and proximal colon for the treatment of Chronic Idiopathic Constipation and Irritable Bowel Syndrome.

The present invention recognizes several reasons why the distal jejunum, ileum, cecum and proximal colon is the preferred target for an effective GCCR agonist and for any secretagouge intended for the treatment of CIC and IBS-c and IBS-m. These reasons include, for instance the distribution of Guanylyl Cyclase C receptor in the intestine: In addition to the duodenum, the ileum, cecum, and colon also express significant GCCR activity and function. Moreover, STa peptides are much more stable in the ileum than in the duodenum: Half life in duodenum about 3 minutes but about 30 minutes in the ileum (Kessler et al, 2009; Kessler et al, 2008).

In addition, delivery of a GCCR agonist to the distal jejunum, ileum and proximal colon provides much better control of stool hydration: Most fluid that enters the duodenum is absorbed in the jejunum and ileum (Feldman et al., 2006). An agonist acting in the duodenum must contribute large amounts of fluid, possibly as much as up to 3 liters, to overcome this. The absorption of this large fluid flow through the intestine is variable. This causes large swings in stool hydration and causes occasional diarrhea. Avoiding this diarrhea limits dose range and efficacy. Thus, slow release delivery to the distal jejunum, ileum, cecum and proximal colon can provide several hours of low level fluid secretion. This creates a smaller and slower fluid flow closer to the colon. Less fluid contribution is required, as the fluid will not be re-absorbed as much since it will need to travel only a short distance before it reaches the colon. There is also much less variability in the absorption in this fluid flow as it does not have to travel through most of the intestine before it reaches the colon. This greatly increasing control of stool hydration, and affords the ability to increase dose and efficacy.

Distribution of Guanylyl Cyclase C receptor in the intestine

Figure 4:
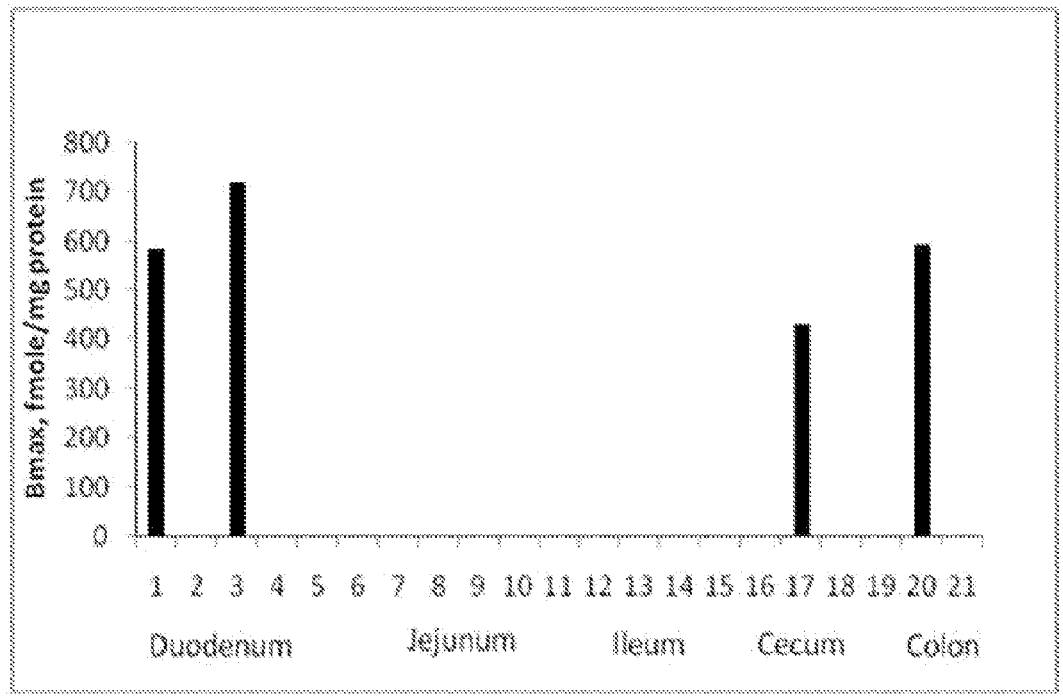
Figure 5:
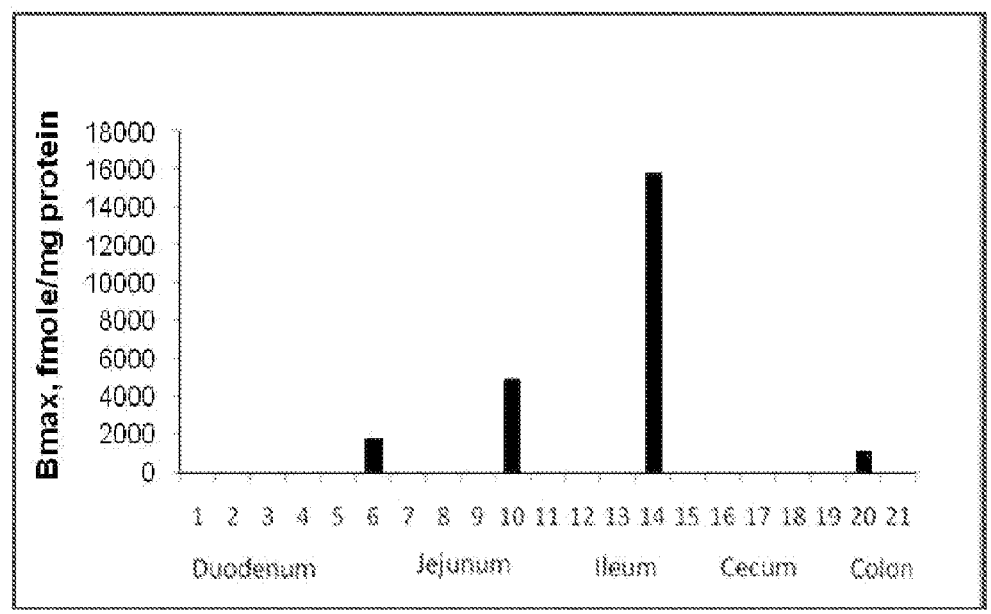
Figure 6:
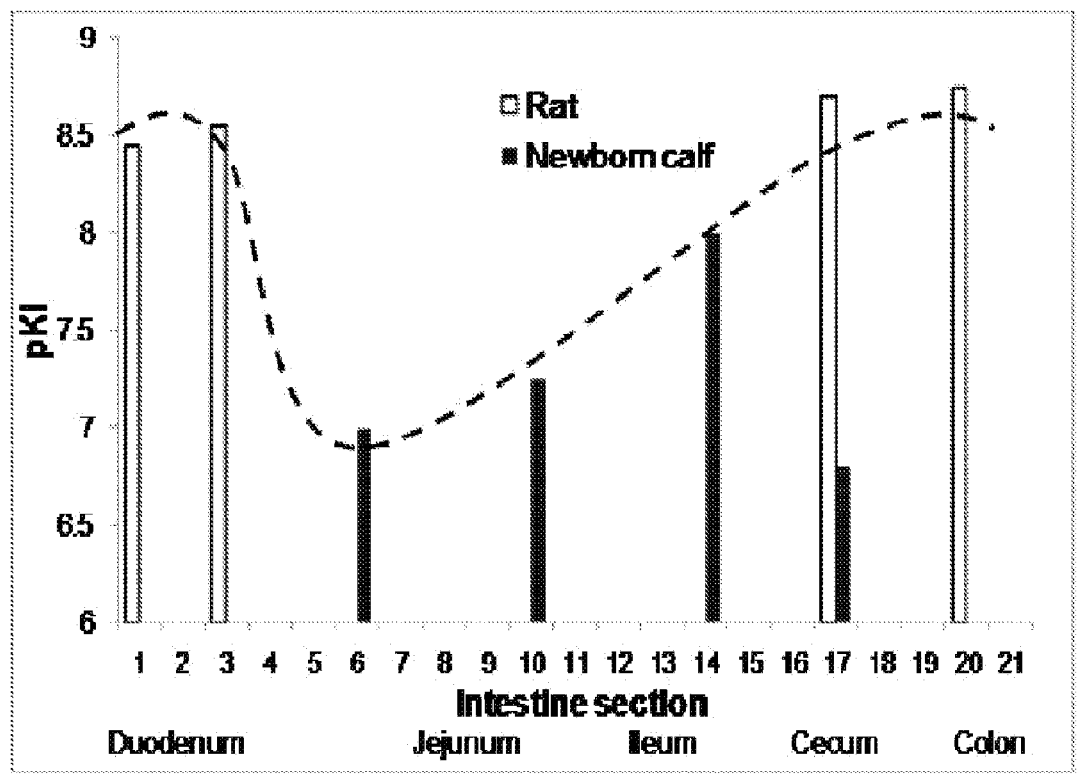
Figure 7:
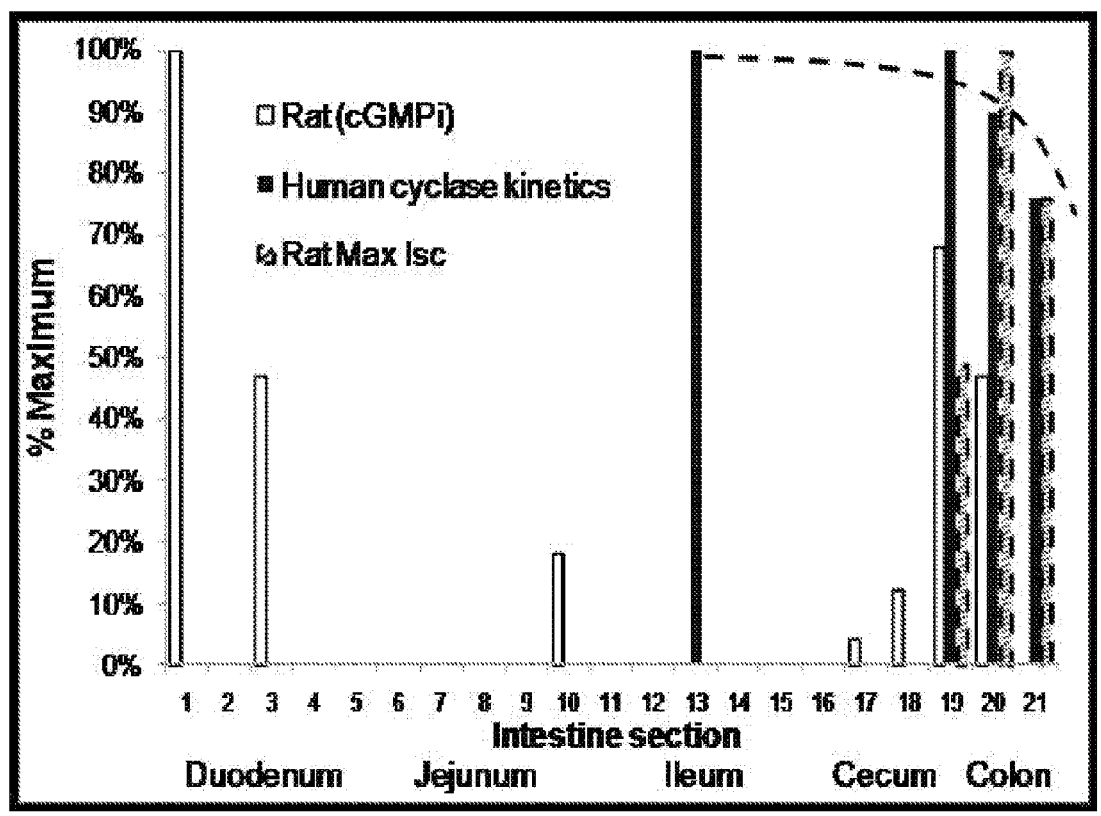

According to the present invention, it is recognized that rational development of a formulation that provides the optimal site of action through modified release of compounds that activate GCC, would require knowledge of expression and activity levels of GCC protein throughout the intestine. The work of Krause (1994 a,b) and Qian (2000) describes the relative receptor density (Bmax fmole/mg protein) of GCC along the rostral-caudal axis of the intestine in Sprague-Dawley rats and newborn calves. As seen in FIG. 4, similar levels of GCC protein (STa-binding activity) are observed in the duodenum, cecum and colon of the rat. A complementary set of data from the newborn calf (FIG. 5) indicates an even higher level of GCC protein expression in the ileum relative to that observed in the colon (Al-Majali et al., 2000). Note: The divisions along the rostral-caudal axis in FIGS. 6 and 7 are based on those used in the paper by Qian et al., 2000. Prior to the present invention, conventional efforts have failed to develop a method of use for a formulation that provides modified release of compounds in the distal jejunum, ileum, cecum and proximal colon.

Guanylyl Cyclase C Receptor Affinity for STa (1-18)

An examination of affinity data (Ki) reveal similar affinities (1-4 nM Ki) for GCC expressed in the duodenum, cecum and colon. However, it should be noted (FIG. 6) that a 2 log decrease in the affinity of STa (1-18) for its receptor is seen for GCC expressed in the jejunum and cecum of the calf. This may be due to differences in GCC sequence homology between species.

In a study of human small intestine (n=20) and colon (n=24) specimens, Cohen (Gastroenterology, 1988) reported similar affinities for the interaction of STa (1-18) with GCC in these two tissues (1.9 nM and 1.2 nM, respectively). Although no correlation of receptor affinity with age (6 months to 16 years) was observed, Cohen did report a 75% decrease in the absolute expression of GCC with increasing age in this group. Furthermore, the level of GCC found in the small intestine relative to the colon increased as the patient population matured (small intestine:colon ratio of 0.9 at 6 months and a ratio of 1.8 at 15 years). Additionally, a log-linear increase in guanylyl cyclase activity was observed with increasing number of GCC receptors.

Distribution of Guanylyl Cyclase C Receptor Activity in the Intestine

Studies of GCC activity induced by incubation with STa (1-18) in human (Krause 1994) and rat (Cohen, 1989 and Qian, 2000) specimens supported Cohen's earlier findings (Cohen 1988) of a correlation of GCC protein expression with Guanylyl Cyclase activity. As was observed for GCC expression and affinity, high levels of GCC activity were observed in the proximal duodenum, ileum and colon, with reduced activity in the jejunum (as shown in FIG. 7).

Time Course of Guanylyl Cyclase C Activation

Figure 8A:
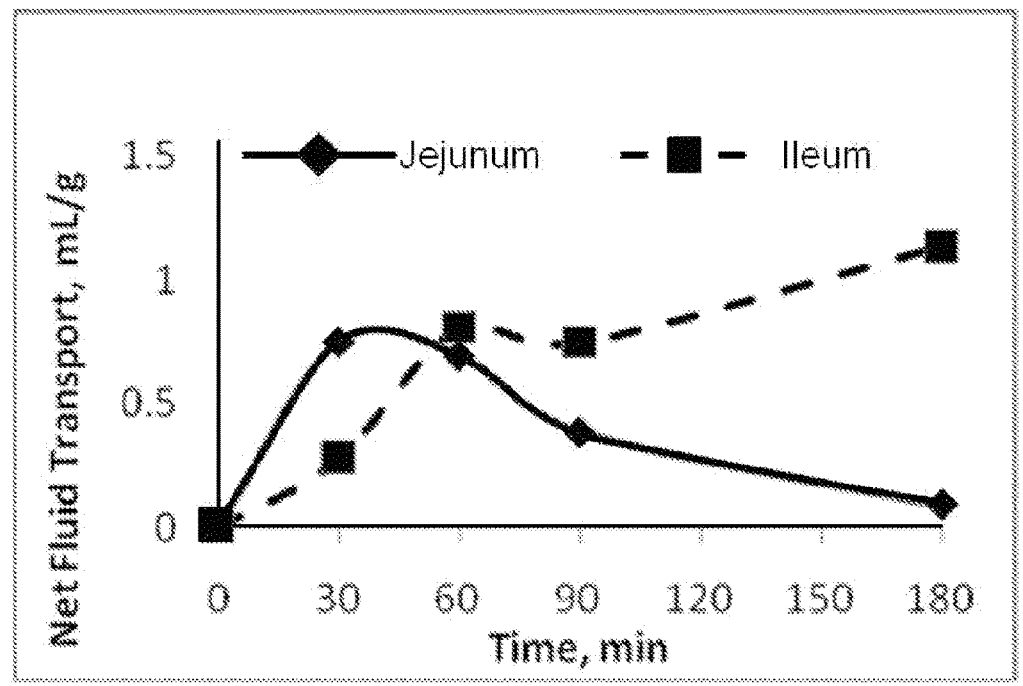
Figure 8B:
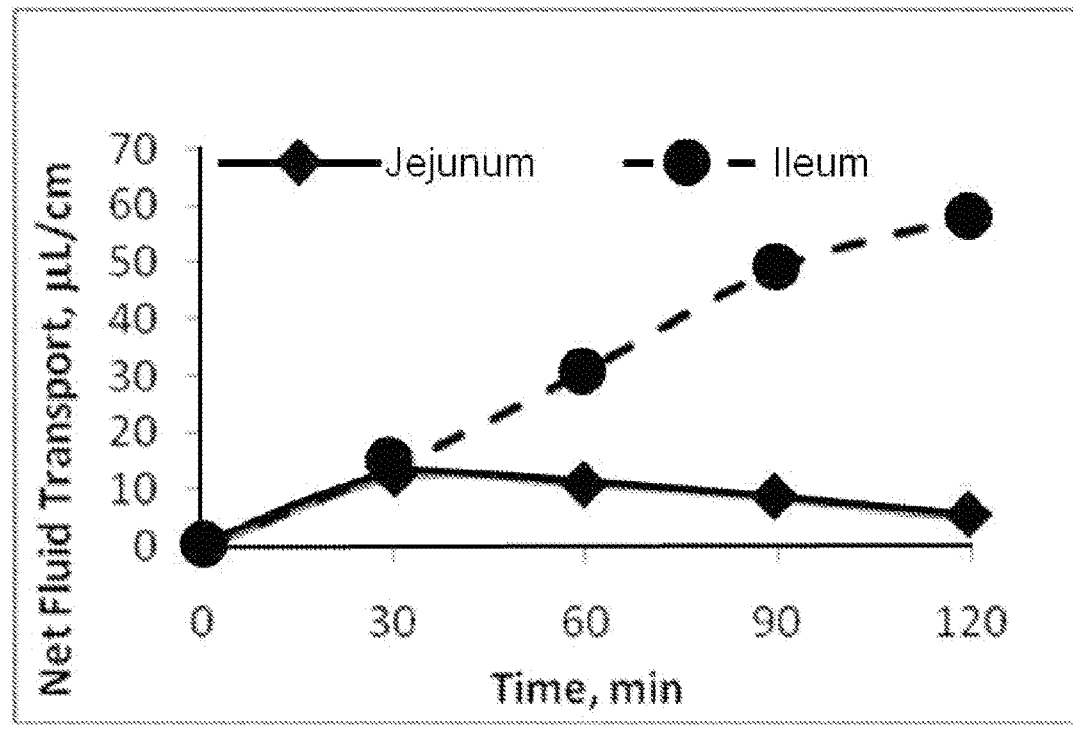

In separate studies examining the duration of response to STa (1-18) in intestinal loops, both Cohen (Cohen et al., 1989) and Nzegqwu & Levin (Nzegqwu & Levin, 1994) found a significantly longer duration of response in the Ileum relative to the jejunum (FIGS. 8a and 8b). The response in the ileum was also delayed compared to the response in the jejunum. Also of note is a study published by Shimonishi et al. (1987) demonstrating a significantly longer duration of response with Q-Cys5-STa (5-17) relative to its L-analog.

STa Peptides are Much More Stable in the Ileum than in the Duodenum

According to the present invention, there are additional reasons why the distal jejunum, ileum, cecum and proximal colon are the preferred targets for a GCCR agonist. Namely, STa peptides have been observed to have a half-life in the duodenum of about 3 minutes; compared to a half-life of about 30 minutes in the ileum (Al-Majali et al., 2007; Sellers et al., 2008; Kessler et al., 2008; Kessler et al., 2009). ST peptides are stable in the stomach but are rapidly degraded in the upper intestine. Linaclotide has been shown to be stable in simulated gastric fluid for up to 3 hours (Busby et al, 2010). However, linaclotide is degraded rapidly in the duodenum. In intestinal fluids from both mouse, rat and humans the peptide loses its C-terminal tyrosine and forms an active metabolite. The half life for linaclotide is 3 minutes in rat intestinal fluid and 1 minute in human intestinal fluid. This metabolite is also rapidly degraded, first by reductases and then by proteases. The half life for the metabolite is about 5 minutes in rat intestinal fluid, and 3 minutes in human intestinal fluid. It is not detectable after 60 minutes in rat intestinal fluid, and after 18 minutes in human intestinal fluid (Kessler et al., 2009; Kessler et al., 2008). Thus, if released in the stomach or duodenum, an ST peptide analogue such as linaclotide will be active only in the duodenum. It is likely that an uroguanylin analogue such as plecanatide is degraded even more rapidly and therefore has an even shorter activity time.

However, it has been observed that linaclotide is more stable in ileal intestinal fluid taken from the ileum than in fluid taken from the duodenum or jejunum. Kessler has shown that the half life in rat duodenal fluid was about 0.44 minutes, 0.36 in jejunal fluid, but about 30 minutes in ileal fluid (Kessler et al., 2008; Kessler et al, 2009). This correlates with the free thiol concentrations in these locations and the activity of the Glutathione Reductase/Glutareduxin system activities in these locations. Kessler also showed that both rat and human intestinal fluid has a high activity Glutathione Reductase/Glutareduxin system, and that the activity of the system in the human intestine is as high or higher than in the rat (Kessler et al., 2008; Kessler et al, 2009).

Lower level of thiols and reductases in ileal intestinal fluid predicts enhanced drug stability in ileum. Because of the higher concentration of reductases and thiol concentration in the duodenum and jejunum, as compared to the ileum, there is higher stability of STa peptides or uroguanylin peptides in the ileum. Thus, linaclotide is up to 100× more stable in ileal intestinal fluid due to a lower level of reductases compared to in the duodenum.

Improved Control of Stool Hydration Levels

Secretagogues (such as linaclotide and plecanatide) acting in the upper intestine have to introduce large amounts of fluid to affect colon stool fluid content. Most fluid introduced in the upper intestine is absorbed in the jejunum and ileum (Feldman et al., 2006, Bliss et al., 1999).

The colon is capable of enhancing fluid re-absorption in response to heightened ileo-cecal flow, which is a natural mechanism to avoid diarrhea. However, the colon is also sensitive to transient flows of fluid, as it may not always be able to adjust fluid absorption sufficiently fast. To overcome the absorption of fluid in the jejunum and ileum, and the regulation of fluid by the colon, and add net water to the stool, the effect of a duodenally-acting secretagogue must be considerable, adding in upwards of 3 liters of fluid. Most of this fluid will be absorbed in the small intestine. However, the natural variability in absorption, enhanced by the extra fluid flow, creates swings in stool fluid content after treatment with a secretagogue that acts in the duodenum or upper jejunum. The resulting titration of fecal fluid will be imprecise and results in wide swings in net fecal water. Moreover, the colon may not be able to adjust quickly enough to transient increases in fluid flow, further increasing the likelihood of diarrhea.

The incidence of diarrhea after linaclotide treatment can range between 13% and 20%, narrowing the therapeutic window and efficacy for the compound. Numerous patients actually dropped out of clinical studies with linaclotide because of diarrhea (Lembo et al., 2010a; Lembo et al., 2010b; Ironwood Pharmaceuticals 2010). This is worrisome, as efficacy and tolerability typically drop further as drugs are translated from clinical trials to medical practice. With regard to clinical results observed with linaclotide, the primary efficacy endpoint of three or more CSBMs per week and an increase of at least one CSBM per week over baseline for at least nine of the 12 weeks of the treatment period was achieved by only 21% of patients (Bryant et al., 2010).

For at least these reasons, a secretagogue drug (such as linaclotide or plecanatide) that is released in the stomach, duodenum or proximal jejunum is acting in a less suitable site for stool hydration therapy and has several disadvantages compared to drugs that drug that are released in the distal jejunum, ileum or in the proximal colon. In the case of treatment with a secretagogue such as an ST peptide drug or a uroguanylin peptide drug that is released in the stomach or the duodenum, the small bowel and colon are required to reabsorb a large fluid load secreted by the duodenum in order to hydrate the stool; this is a very inefficient system prone to error (i.e. diarrhea). Moreover, any downward adjustment of the dose of drug to avoid diarrhea would result in reduced efficacy, and the merits of treating CIC and IBS with a GCCR agonist will not be fully realized.

In practice, patients will over-dose and under-dose secretagogues and similar-acting drugs. This has been the exact experience in the past with cathartic drugs sold over the counter. However, due to the imprecise control of stool hydration afforded with a GCCR agonist acting in the duodenum or proximal jejunum, it will be difficult for patients to achieve optimum effect. A drug with a more optimal therapeutic window (efficacy vs. tolerability) is therefore still needed (Bharucha & Waldman, 2010).

Unexpected Advantages of Slow Release Formulations

Slow release formulations of the present invention have unexpected advantages. The intestine, including the colon, has a limited capacity to absorb high transient fluid flows. Immediate release formulations of secretagogues can therefore lead to fluid flows that cannot be absorbed and that can cause diarrhea. If the drug is instead released slowly, over a time period between 1 hour and up to 8 hours, the fluid flow can instead be managed by the intestine, causing a slow and manageable increase in stool hydration. This will cause less swings in stool hydration and a more manageable and titratable therapeutic effect.

Unexpected Advantages of the Ileal-Cecal-Colon Site of Action of the Present Invention The ileal, cecal or colon release formulations of the present invention, preferably distal jejunum, ileal or proximal colon slow-release formulations, are predicted to achieve many more significant and unexpected advantages compared to conventional approaches, including unexpected improvement in efficiency of stool hydration and improved colonic fluid content regulation.

The unexpected advantages of stool hydration therapy of the present invention obtained from e.g., the ileal slow-release formulations, include, for instance, inducing a sustained flow of fluid resulting from low levels of secretion in the most sensitive end-organ (i.e. the colon).

Formulations of at least one such compound of the present invention, SEQ ID NO 60, are predicted to be several-fold more effective when released in the distal jejunum, ileum and colon; and small amounts of the drug (SEQ ID NO 60) can be titrated to effect a sensitive dose response. Moreover, the therapeutic window will be improved with such a slow release formulation, leading to better therapeutic response and lower rates of diarrhea and drug discontinuation, and higher rates of efficacy and tolerability, especially in the elderly, an important target population for these agents.

Also, techniques for preparing controlled-release, delayed-release, and/or slow-release formulations (e.g., for release in the ileum) can be employed, which techniques are well known in the art for other types of pharmaceutical compounds (e.g., see Remington, J P. Remington's Pharmaceutical Sciences. Mack Pub. Co.; 16th edition; 1980).

Further Advantages of the Stool Hydration Agents of the Present Invention

The agents of the present invention can be delivered to the stomach, duodenum, jejunum, ileum and colon, and will be therapeutically active there. However, the exemplary stool hydration agent acts on the target organ; the colon. According to the present invention, the most sensitive and optimal place to effect a controlled change in stool and water absorption/ secretion is the distal jejunum, ileum, cecum and proximal colon, not the stomach, duodenum or proximal jejunum.

Creating an environment of secretion in the proximal intestine would be the least efficient means one could develop to adjust intestinal fluid content and improve end-stool consistency; the mechanism would be inherently prone to uncontrolled swings of excess fluid output (i.e., diarrhea).

Instead, according to the present invention, the ideal stool hydration agent works in the distal jejunum, ileum, cecum and proximal colon by introducing small amounts of fluid over an extended period of time. As a result, a small amount of fluid avoids disturbing the colon into generating diarrhea. Also, introduction of the ileal-release formulation over time permits an extended section of stool to be hydrated.

Although targeting the distal jejunum, ileum, cecum and proximal colon is preferred, this is not to exclude embodiments of the present invention that target other parts of the GI tract such as the stomach, duodenum or proximal jejunum. The compounds of the present invention will be therapeutically active in those other parts of the GI tract, although with disadvantages as discussed above.

Improvement in Fluid Regulation in the Colon

Figure 9:
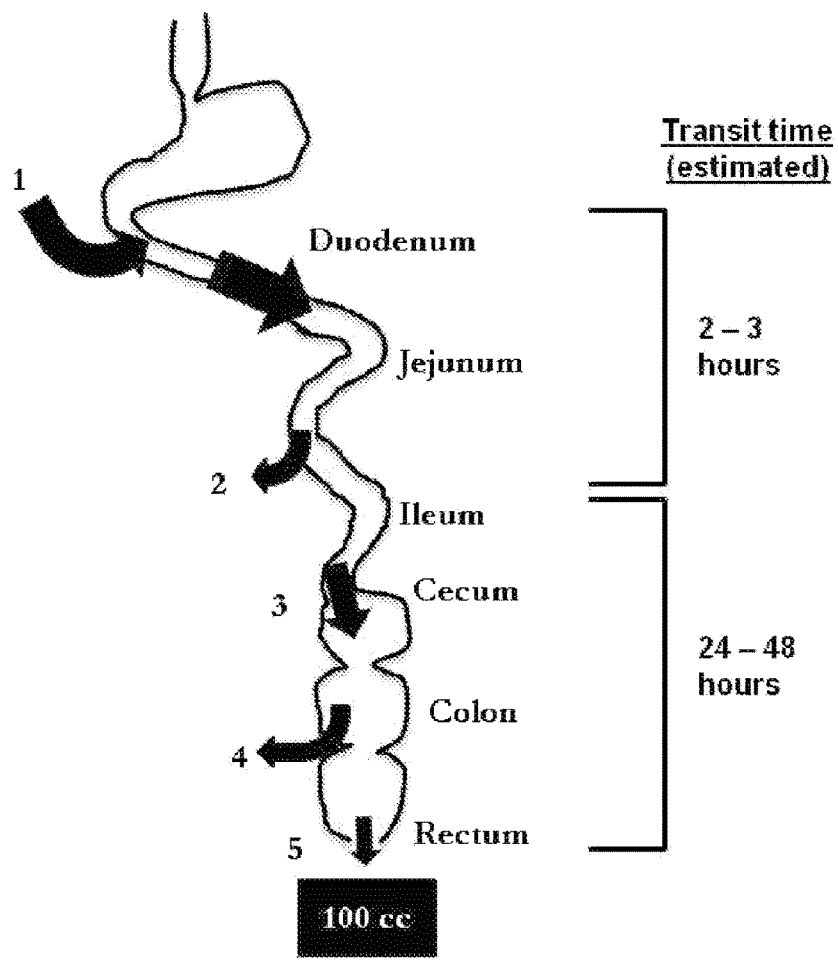
FIG. 9 is a graphical overview of intestinal fluid volumes and transit times.

FIG. 9 depicts an overview of normal fluid regulation in the colon (no drug treatment). The text in FIG. 9 refers to the number references in the FIG. 1) Approximately 9 L of fluid enters the upper small bowel each day from ingestion (2 L), saliva (1.5 L), gastric secretion (2 L), bile (0.5 L), pancreatic secretion (1.5 L) and intestinal secretion (1.5 L). 2) Of this, approximately 7.5 L is absorbed in the small bowel (jejunum and ileum). 3) Only about 1.5 L enters the colon. 4) Over 90% of this ileo-cecal fluid flow is absorbed there. Only about 100 cc of fluid is excreted in the stool. The colon is the main control point for stool hydration and composition. It can augment absorption in response to an increase in the fluid flow, but only up to about 3× increase. It is also sensitive to transient high fluid flows, which can cause "breakthrough" diarrhea. 5) Normal stool contains about 100 to 200 cc of fluid excreted per day. Less than 50 cc excretion per day is indicative of constipation, while more than 200 cc per day is indicative of diarrhea. Thus, the difference between hard and soft stool is quite small, about 30 cc (Feldman et al., 2006; Aichbichler et al., 1998; Bliss et al., 1999).

Figure 10:
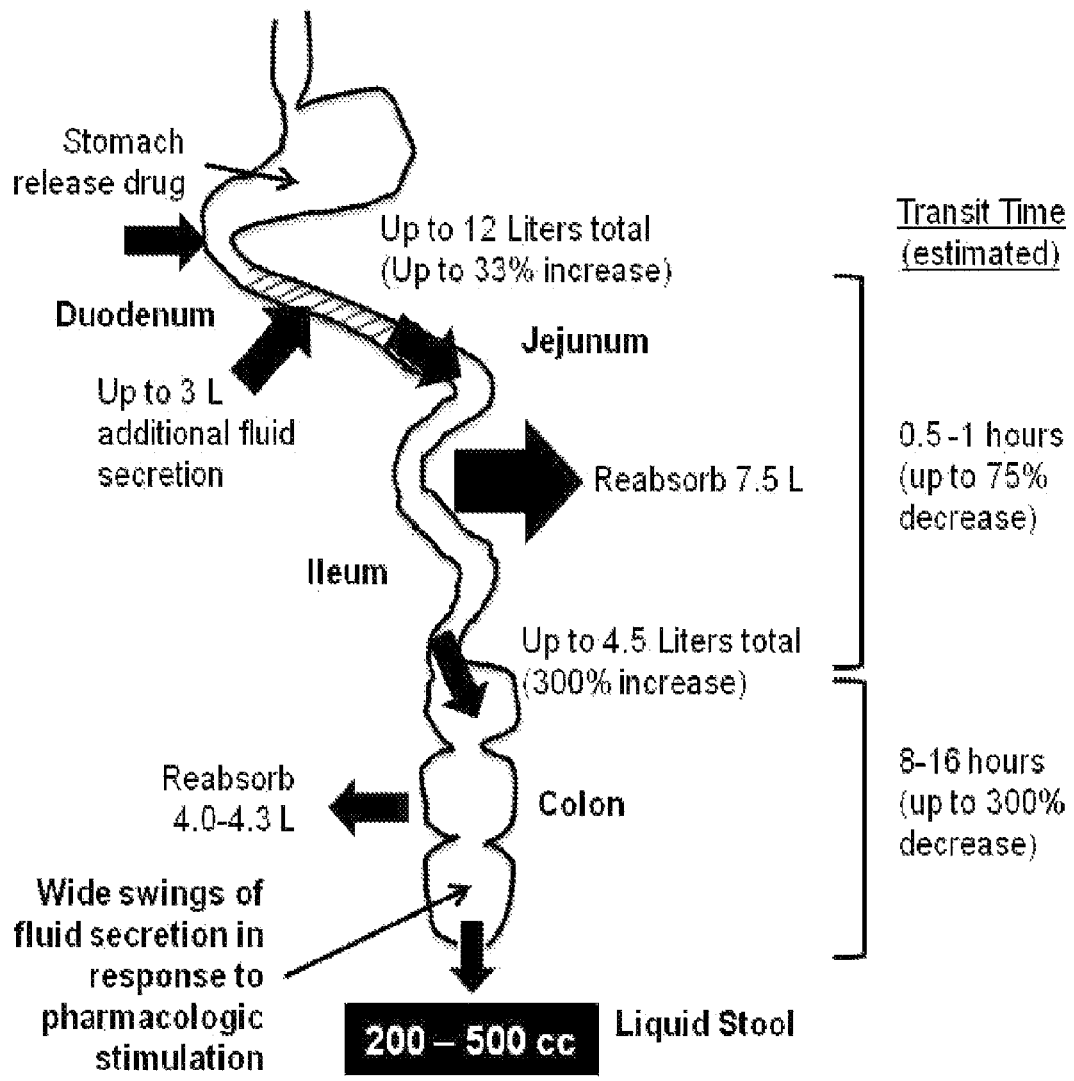
FIG. 10 is a graphical overview of the fluid regulation system in the colon where a stomach release drug is used.

FIG. 10 depicts an overview of the fluid regulation system in the colon after administration of an ST or Uroguanylin peptide drug that is released in the stomach or duodenum (Feldman et al., 2006; Aichbichler et al., 1998; Bliss et al., 1999; Bryant et al., 2010; Busby et al., 2010). A GCC peptide drug (such as linaclotide or plecanatide) that is released in the stomach or will be stable there (ST and Uroguanylin peptides are usually acid stable). Once it enters the intestine it will be rapidly broken down, with a half life in the intestine of about 5 minutes in total (including active metabolites) and be active for about 15 minutes. The main site of drug activity will therefore be in the duodenum. A GCC peptide drug that is released in the duodenum will have a similar half life and activity period once it is released. This will result in wide swings of fluid secretion in response to pharmacologic stimulation as described above.

Figure 11:
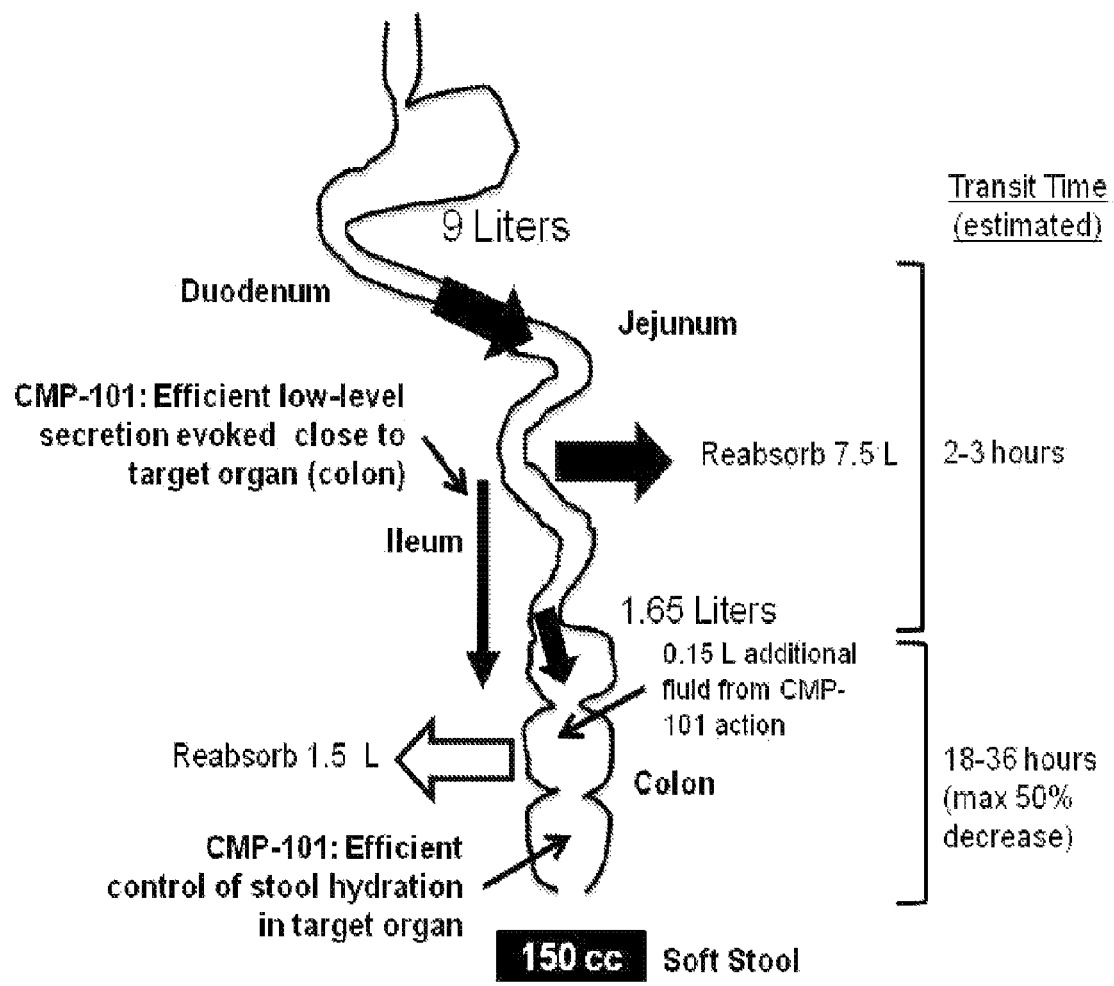
FIG. 11 is a graphical overview of the fluid regulation system in the colon where a secretagogue drug released in the area between the distal jejunum, ileum, cecum and proximal colon is used.

By comparison, FIG. 11 depicts an overview of the fluid regulation system in the colon after administration of a formulation that releases the secretagogue drug in the region of the distal jejunum, ileum, cecum and/or proximal colon, in accordance with the present invention. As described herein, this type of release formulation offers numerous unexpected advantages, including a safer, more effective and more controllable mechanism for hydrating the stool. By acting close to the end organ (colon), less net secretion is needed to hydrate the stool. This represents a safer, more effective and more controllable mechanism to hydrate the stool. (Feldman et al., 2006; Aichbichler et al., 1998; Bliss et al., 1999; Bryant et al., 2010; Busby et al., 2010).

Improvement in Colonic Fluid Content Regulation

Figure 12:
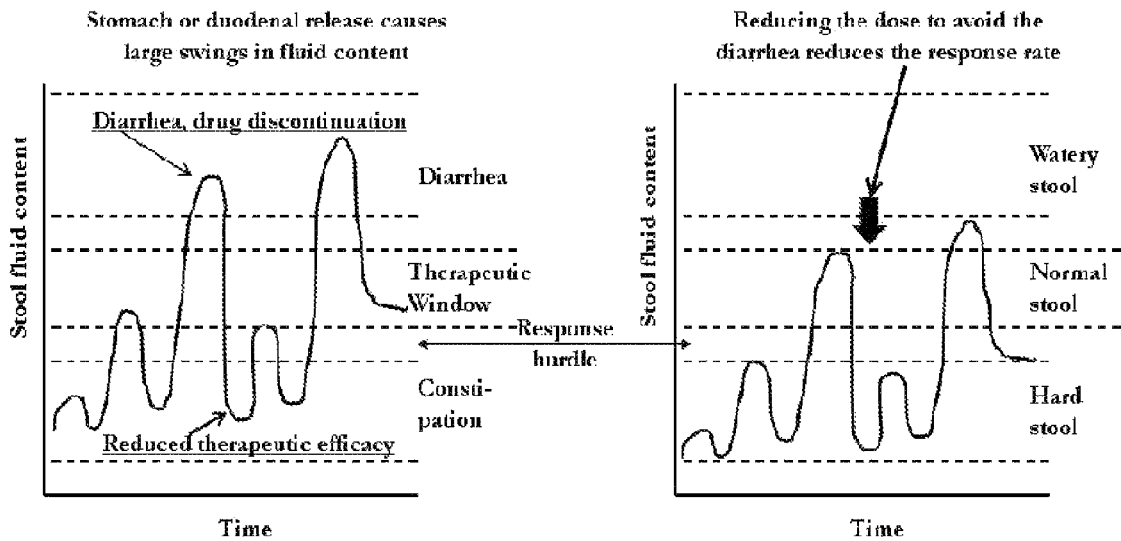
FIG. 12 is a plot of colonic fluid content regulation with duodenal or stomach release drug.

FIG. 12 depicts colonic fluid content regulation after administration of a conventional stomach or duodenal releasing secretagogue drug. The large swings in stool fluid content that are caused by the drug require the dose to be lowered, reducing the response rate to the treatment.

Figure 13:
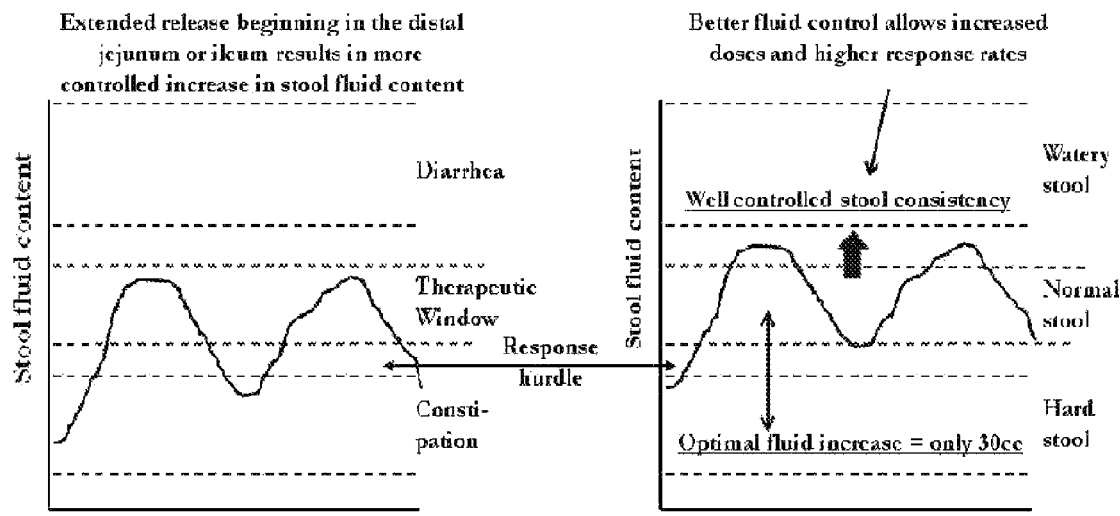
FIG. 13 is a plot of colonic fluid content regulation with a drug that is released in the region from the distal jejunum, ileum, cecum and proximal colon.

By comparison, FIG. 13 depicts colonic fluid content regulation after administration of a releasing drug formulation that releases the drug starting in the distal jejunum, ileum, cecum and/or proximal colon, in accordance with the present invention. As illustrated, extended release in this region permits a more controlled increase in stool fluid content. Slow release of the secretagogue drug closer to the target organ (colon) requires the secretion of less fluid since less fluid will be absorbed before the drug reaches the colon. This in turn provides better control of fluid flow, less swings in stool hydration and better control of therapeutic effect. This in turn results in higher therapeutic response rates.

Additional Features of the Formulations of the Present Invention Designed to Release in the Distal Jejunum, Ileum, Cecum and/or Proximal Colon According to another embodiment of the invention, the target product profile for the distal jejunum, ileal, cecal and/or proximal colonic releasing formulations of the invention can be used in the design of the formulations. Also, knowledge about GI tract physiology, GCC receptor distribution in the intestinal tract, and reductase distribution, are also used in formulation design.

Figure 14:
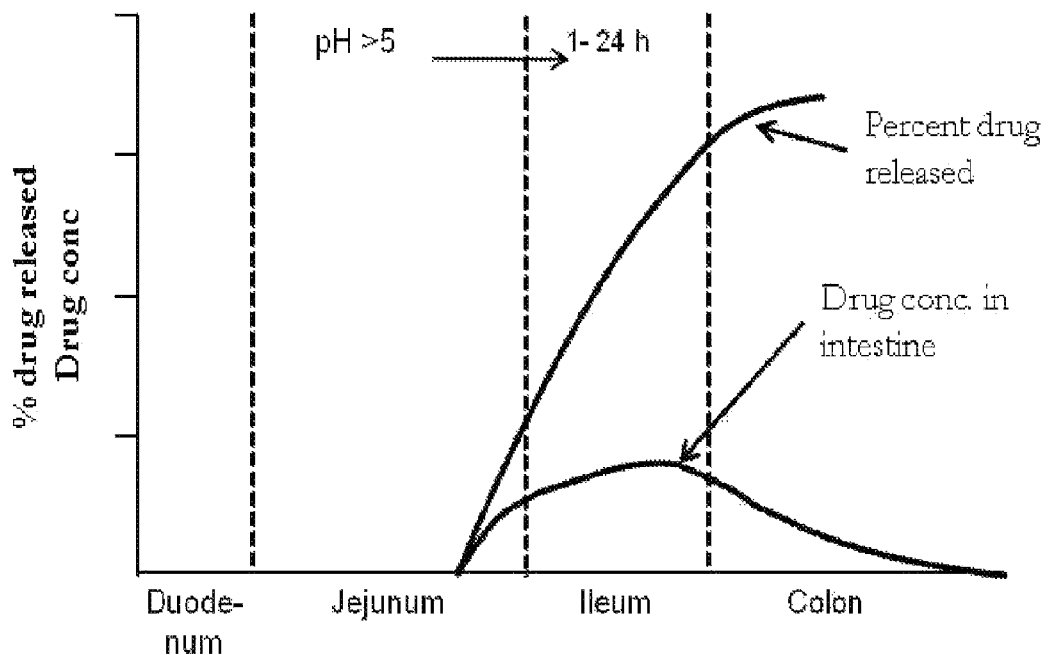
FIG. 14 is a plot of an example formulation design profile, starting the release of the drug in the distal jejunum.

FIG. 14 illustrates one example of a formulation designed to start releasing in the distal jejunum, in accordance with the present invention. The design can also be intended to release the drug over a time period of between 1 and 24 hours. Such formulation design criteria include, but are not limited to, a pH dependent coat; a slow-release core; bead formulation to disperse the active ingredient in the intestine; use of a capsule or tablet matrix; and one or more excipients to stabilize the active ingredient. Release of a ST peptide or Uroguanylin drug in this region will result in longer activity due to longer half life (Kessler et al., 2008; Kessler et al., 2009). In addition, longer activity of the drug can also be achieved by incorporating design features in the formulation that protect the drug from the intestine environment until it is released. Other profiles can start the release in the ileum, cecum and/or proximal colon. The time profile of the release can also be varied, with release occurring over a time period between 1 and 24 hours.

Constipation is a multifaceted condition, but stool hydration provides relief in the vast majority of patients. As described further herein, the present invention provides unexpected advantages with regard to improved stool hydration.

Figure 15:
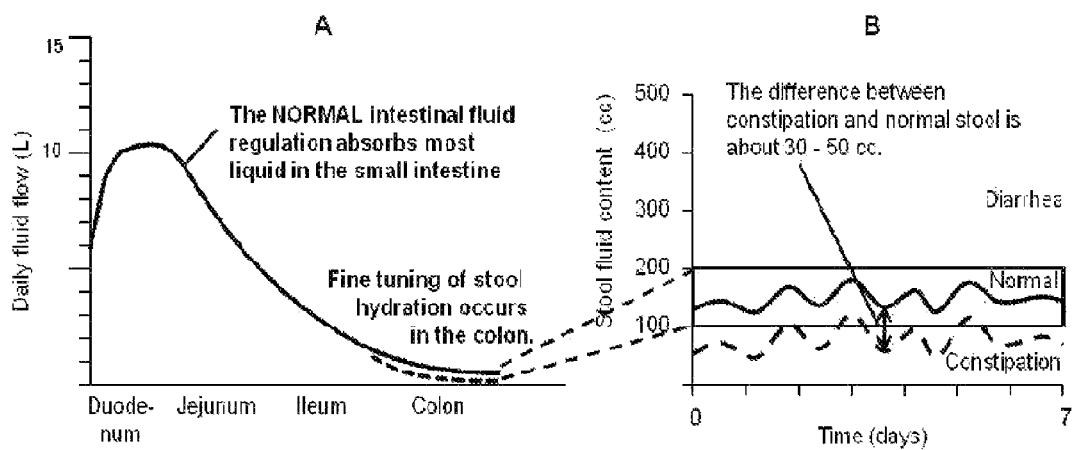
FIG. 15 is a plot of intestinal fluid flow and stool hydration control under normal and constipated conditions.

FIG. 15 depicts a summary of intestine fluid flow and stool hydration control under normal conditions, as compared to constipation. As shown, the difference between constipation and normal stool is as little as 30 to 50 cc of fluid content in the stool per day. This provides a narrow target for a stool hydration agent, and control of stool fluid content is therefore an important consideration for these types of therapeutics. As depicted in part A of FIG. 15, the intestine secretes and absorbs large amounts of fluids daily, with the absorption taking place in the small intestine and fine control of stool fluid content taking place in the distal colon. Part B of FIG. 15 depicts stool fluid content in the stool over 7 days, normal and constipated. Normal stool stays in a tight range of hydration, about 100 to 200 cc per day. Constipation occurs when stool is hydrated 30 to 50 cc to little.

FIG. 16 shows that treatment with a secretagogue that is released in the stomach or duodenum is associated with large swings in stool fluid content. To add 30 cc of fluid to the stool, a drug that is released in the stomach or duodenum must induce secretion of up to 3 liters in the duodenum. Part A of FIG. 16 depicts daily fluid flow through the intestine where a stomachally or duodenally acting agent is used. To affect a small difference in the stool, a duodenally acting agent must induce secretion of a large amount of fluid. This is dictated by the physiology of the gastrointestinal tract. Part B of FIG. 16 depicts stool fluid content in the stool over 7 days where a stomachally or duodenally acting agent is used. Natural variability in re-absorption will result in large swings in stool fluid content. Titration of fecal fluid will be imprecise, resulting in over- and under-treatment. To avoid this, the dose of the drug must be lowered, resulting in a lower overall response rate.

FIG. 17 shows that an ileal slow release formulation, in accordance with the present invention, unexpectedly and surprisingly allows much better control of stool hydration, resulting in higher clinical response rates. A stool hydration agent should ideally act in the target organ; the colon. Much less net secretion will be needed to hydrate the stool. Part A of FIG. 17 depicts daily fluid flow through the intestine where an ileal slow release formulation is used. Part B of FIG. 17 depicts stool fluid content in the stool over 7 days where an ileal slow release formulation is used. Tighter control of stool hydration permits more precise dose titration with a resulting higher response rate. Thus, an ileal slow release formulation allows much better control of stool hydration, resulting in higher clinical response rates, in accordance with the present invention.

It is to be understood that any suitable excipients, dosage forms, and range of concentrations can be employed to prepare the formulations contemplated by the present invention. Representative excipients, dosage forms, and concentrations can be selected to achieve the desired properties of the formulation. Exemplary excipients include, but are not limited to, stabilizing agents; solubilizing agents; diluents; binders; lubricants; etc. Thus, the peptides can be included in a unit dose form, together with suitable carriers, excipients and diluents. As used here the term unit dose form refers to a single delivery vehicle, such as a tablet, capsule, solution or inhalation form. The peptides may also be formulated to be delivered together in combination with another pharmacological agent in the same unit. It is also to be understood that the examples described herein are merely used to illustrate certain embodiments of the invention, but are in no way intended to limit the scope of the invention.

Controlled Slow Release Formulation

In one embodiment, GCC peptide formulations comprise a composition which provides a controlled release (e.g. time-dependent, pH-dependent, temperature-dependent, ionic strength-dependent, viscosity-dependent) of the GCC peptide. Controlled release may mean delayed sustained release, delayed controlled release, delayed slow release, delayed prolonged release, delayed extended release, and sudden release or several sudden releases (or "bursts") at differing times or locations.

Examples of controlled formulations are where a slowly disintegrating core comprising the GCC peptide is surrounded by the targeting composition. The targeting composition preferably comprises at least one swellable polymer. Non-limiting examples of such polymers are acrylic copolymers, e.g., EUDRAGIT RL, EUDRAGIT RS, or EUDRAGIT NE; polyvinylacetate, e.g., KOLLICOAT SR 30D; and cellulose derivatives such as ethylcellulose or cellulose acetate, e.g., SURELEASE and AQUACOAT ECD, poly(hydroxalkyl methacrylate) having a molecular weight from 20,000 to 5,000.000; kappa-carrageenan; polyvinylpyrrolidone having a molecular weight of from 10,000 to 500,000; anionic and cationic hydrogels; polyelectrolyte complexes; poly(vinyl alcohol) having low amounts of acetate, cross-linked with glyoxal, formaldehyde, or glutaraldehyde and having a degree of polymerization from 200 to 30,000; a water-insoluble, water-swellable copolymer produced by forming a dispersion of maleic anhydride with styrene, ethylene, propylene or isobutylene; water-swellable polymers of N-vinyl-lactams; polysaccharide, water swellable gums and/or mixtures thereof, cross-linked polysaccharide, water insoluble starch, calcium pectinate, microcrystalline cellulose, water insoluble crosslinked protein, water insoluble cross-linked gelatin, water insoluble cross-linked collagen, and cross-linked polyacrylic acid, disintegrants such as microcrystalline cellulose, kaolin, titanium dioxide, fumed silicon dioxide, alumina, niacinamide, sodium lauryl sulfate, low molecular weight polyvinyl pyrrolidone, m-pyrol, bentonite, magnesium aluminum silicate, polyester, and mixtures thereof.

The formulation may also comprise a water insoluble polymer and a pore-forming agent. Non-limiting examples include saccharose, sodium chloride, potassium chloride, polyethyleneglycol, water soluble organic acids, sugars and sugar alcohol.

The formulation may also comprise a compression coating. Non-limiting examples are xanthan gum, locust bean gum, galactans, mannans, alginates, gum karaya, tragacanth, agar, accacia, carrageenan, chitosan, agar, hydrocolloids acacia catechu, salai guggal, copaiba gum, asafetida, cambi gum, mastic gum, benzoin gum, sandarac, gambier gum, guar gum, welan gum, gellan gum, tara gum, locust bean gum, carageenan gum, glucomannan, galactan gum, sodium alginate, tragacanth, chitosan, xanthan gum, deacetylated xanthan gum, pectin and cultured plant cell gums, as well as mixtures thereof.

The formulation may also include a suspending agent, a plasticizer, a stiffening agent, a wetting agent, a or a dispersing agent, or combinations thereof. Non-limiting examples are dibutyl sebacate, polyethylene glycol and polypropylene glycol, tributyl citrate, acetylated monoglyceride, acetyl tributyl citrate, triacetin, dimethyl phthalate, benzyl benzoate, butyl and/or glycol esters of fatty acids, oleic acid, castor oil, camphor, glycerol and sorbitol or a combination thereof.

The formulation may also include a wetting agent. Non-binding examples include poloxamer, polyoxyethylene ethers, polyoxyethylene sorbitan fatty acid esters, polyoxymethylene stearate, sodium lauryl sulfate, and docusate sodium. The formulation may also include a suspending agent. Non-limiting examples include alginic acid, bentonite, carbomer, carboxymethylcellulose, carboxymethylcellulose calcium, hydroxyethylcellulose, colloidal silicon dioxide, dextrin, gelatin, guar gum, xanthan gum, kaolin, magnesium aluminum silicate, maltitol, sodium alginate, sorbitan fatty acid esters, and tragacanth. The formulation may also include a dispersing agent. Non-limiting examples for dispersing agents are poloxamer, polyoxyethylene sorbitan fatty acid esters and sorbitan fatty acid esters.

The targeted release composition may contain an outer enteric coating over the targeted release material. Such coatings may be selected from the group consisting of cellulose acetate phthalate, hydroxy propyl methyl cellulose acetate succinate, and various EUDRAGIT polymers, or combinations thereof.

The GCC peptide formulation may comprise of one or more natural or synthetic biodegradable polymers and/or pH-dependent release formulations. Non-binding examples include amethacrylic acid copolymers, polyvinyl acetate phthalate, hydroxypropylmethylcellulose, cellulose acetate trimelliate, or hydroxypropyl methyl cellulose acetate Succinate, EUDRAGIT polymers, or combinations thereof.

Sudden Release Formulation

In one embodiment, the GCC peptide formulation may be a time-delayed formulation, designed to release the GCC agonist in a fast burst in the colon or small intestine. These formulations may include at least one disintegrant selected from the group consisting of croscarmellose sodium, crospovidone, cross-linked sodium carboxymethyl cellulose, pregelatinized starch, calcium carboxymethyl cellulose, and magnesium aluminum silicate, at least one of an absorption enhancer, a binder, a hardness enhancing agent, a buffering agent, a filler, a flow regulating agent, a lubricant, a dispersant, a chelator, an antioxidant, a stabilizer, a preservative, and one or more other excipients.

Examples 3 types of experiments were carried out to determine relative potency and efficacy:
Competitive $^{125}$I-labeled radioligand binding on mouse intestine
cGMP accumulation assay
Mouse intestinal secretion assay (suckling mouse assay)
The peptides were also analyzed using standard HPLC and LCMS methodologies.
Example Peptides Used in the Experiments
The above-described experiments were performed using the following peptides:

```
STa (1-18) (ST) SEQ ID NO: 28):
H2N Asn Thr Phe Tyr Cys Cys Glu Leu Cys Cys Asn Pro

Ala Cys Ala Gly Cys Tyr COOH

Linaclotide (SEQ ID NO: 40):
H2N Cys Cys Glu Tyr Cys Cys Asn Pro Ala Cys Thr Gly Cys Tyr COOH Peptide A (A) (SEQ ID NO: 60):
H2N Cys Cys Glu Leu Cys Cys Asn Dhp Ala Cys Ala Gly Cys Tyr COOH -continued
Peptide B (B) (SEQ ID NO: 61):
H2N Cys Cys Glu L-Thr Cys Cys Asn Pro Ala Cys Ala Gly Cys Tyr COOH Peptide C (C) (SEQ ID NO: 62):
H2N Cys Cys Glu Leu Cys Cys Asn HyPro Ala Cys Ala Gly Cys Tyr COOH Peptide D (D) (SEQ ID NO: 63):
H2N Cys Cys Glu Leu Cys Cys Asn Thz Ala Cys Ala Gly Cys Tyr COOH
```

TABLE 9

Summary of experimental data for peptides.

| Peptide | I-125 binding assay | CGMP accumulation assay | Mouse intestinal secretion assay (suckling mouse) |
|---|---|---|---|
| STa(1-18) | +++ | ++++ | ++++ |
| Linaclotide | +++ | +++ | +++ |
| A | +++++ | +++++ | +++++ |
| B | ++++ | +++ | +++ |
| C | ++ | +++ | NM |
| D | +++++ | +++++ | +++++ |

Results are graded from 1+ (lowest activity/potency) to 5+ (highest activity/potency). NM is "not measured".

Intestinal membrane 1-125 labeled radioligand binding assay. The intestinal membrane radioligand binding assay was used to assess whether a novel compound could displace $^{125}$I-STa from GC-C (Crane et al., 1992). Each analog was analyzed for its ability to displace $^{125}$I-STa from GC-C in a competitive binding assay. $^{125}$I-ST Displaced" was determined by co-incubating STa analogs (10 μM) with 50,000 DPM of $^{125}$I-STa (1-18) in the presence of mouse intestinal membranes. The displacement (n=3) for each analog was determined relative to a vehicle control.

Membrane and Tissue Homogenate Preparation:

Membranes were prepared from freshly harvested mouse intestines by first washing away the blood or feces with ice-cold Dulbecco's PBS. Washed organs were minced with a single-edged razor blade, followed by homogenization on ice in 50 mM Tris, pH 7.6, containing 1 mM EDTA, 1 mM PMSF, 1 mM DTT. Debris was then removed by a 15 minute centrifugation at 3,000×G and 4° C. The supernatant is then passed through successively smaller needles (18 gauge through 25 gauge) and frozen at −70° C. until used as a tissue homogenate. If intended for use as isolated membranes, the above homogenate was centrifuged (100,000×G) at 4° C. for 1 hour while fresh and the pellet was re-suspended in homogenization buffer.

Competitive Radioligand Binding Assay:

The assay was performed in 96 well filter plates which were pre-incubated overnight with 200 μl of 0.3% polyethylenimine (w/v) and washed three times by aspiration with 300 μl of Wash Buffer (150 mM NaCl, 20 mM Sodium Phosphate pH=7.2, 1 mM EDTA) immediately before use. Into each well of was added 50 μl of 3× Binding buffer (150 mM Tris-HCl pH=7.6, 1.98 mM Cysteamine, 0.3% Bacitracin, 1350 mM NaCl, 3 mM EDTA), 40 μl of double-distilled water, 10 μl of either double-distilled water or cold ligand (50 uM STa (5-18) in double-distilled water), 10 μl of increasing concentrations (125 DPM/ul to 50,000 DPM/ul) of radiolabeled 125I-STa (1-18) and finally 40 µl (approximately 2 mg protein/ml) of freshly prepared mouse intestine membranes. The plates were then incubated with mixing at 37 C for two hr, washed successively with six 200 µl aliquots of Wash Buffer and aspirated to dryness. The filter bottoms of each well were punched into individual borosilicate tubes and bound radioactivity determined in a gamma counter. Protein content was determined on an aliquot of the mouse intestine membranes used in the Biorad Protein Assay.

Results:

FIG. 18 shows the activity of two different ST peptides of the invention, peptide A (SEQ ID NO 60) and peptide B (SEQ ID NO 61), compared to linaclotide (SEQ ID NO 40) and the natural STa peptide (SEQ ID NO 28), in the 1-125 labeled radioligand binding assay, as described above. In this example peptide B had an activity comparable to STa, and peptide A had a better activity than STa.

FIG. 19 shows the activity of peptide A (SEQ ID NO 60) compared to linaclotide (SEQ ID NO 40) in the 1-125 labeled radioligand binding assay, as described above. In this example peptide A had a superior activity compared to linaclotide.

FIG. 20 shows the activity of peptide A (SEQ ID NO 60), peptide C (SEQ ID NO 62) and peptide D (SEQ ID NO 63)), compared to linaclotide (SEQ ID NO 40) and ST peptide (SEQ ID NO 28), in the 1-125 labeled radioligand binding assay, as described above. In this experiment, peptides A and D had an activity that was superior to ST peptide, while peptide C had an activity that was comparable to ST peptide.

FIG. 21 shows the activity of peptide A (SEQ ID NO 60) and peptide B (SEQ ID NO 61), compared to linaclotide (SEQ ID NO 40), in the 1-125 labeled radioligand binding assay, as described above. In this experiment, peptides A had an activity that was superior to linaclotide, while peptide C had an activity that was lower than linaclotide.

Intact T84 Cell cGMP Accumulation Assay (cGMP Assay):

The intact T84 cell assay was used to detect the accumulation of cGMP, the product of agonism, upon interaction with a compound (Visweswariah et al., 1992). Human colorectal adenocarcinoma T84 cells were grown to confluence in a 24 well plate using DMEM/F12 medium supplemented with 10% FBS. The media was aspirated from each well and the cells were washed three times with Dulbecco's PBS (1×, no Ca2+ or Mg2+). The cells were then incubated for 30 minutes at 37° C. with 1 mM isobutyryl methyl xanthine (IBMX) in Optimem medium (no FBS), either with or without potential antagonists. After incubation under these conditions, a 10× concentrated stock of a known GC-C agonist (e.g., STa (5-18)) in PBS was added to each well and the incubation continued for an additional 15 min at 37° C.

cGMP Radioimmunoassay:

The reaction was stopped by the addition of 200 µL of Passive Lysis Buffer (Promega) to each well. The supernatant was removed for cGMP quantitation by RIA using $^{125}$I-labeled cGMP 54 antibody relative to an external cGMP standard curve. The cells were scraped from the surface for protein content determination using a BioRad Protein Assay.

Results:

FIG. 22 shows the activity of peptide A (SEQ ID NO 60) compared to linaclotide (SEQ ID NO 40) and STa (SEQ ID NO 28) in the cGMP accumulation assay as described above. In this experiment peptide A had an activity that was higher than the STa peptide, while the activity of linaclotide was lower than the STa peptide.

FIG. 22 shows the activity of peptides A (SEQ ID NO 60), B (SEQ ID NO 61), C (SEQ ID NO 62) and C (SEQ ID NO 63), compared to linaclotide (SEQ ID NO 40) and STa (SEQ ID NO 28) in the cGMP accumulation assay as described above. In this experiment peptide A and D had an activity that was higher than the STa peptide, while the activity of peptide B, C and linaclotide was lower than the STa peptide.

Mouse Intestinal Secretion Assay (Suckling Mouse Assay)

A relevant disease model is the suckling mouse model in which STa (5-18) is deposited into the stomach of 3-4 day old mice, and the accumulation of fluid in their intestines is determined gravimetrically (Parkinson et al., 1994). All GCC peptides were formulated to the desired concentration in Dulbecco's PBS (1×, No Ca++, no Mg++) containing 1 methylene blue immediately prior to dosing. Proteinase inhibitors were prepared as stock solutions in PBS and added to dosing solutions by serial dilution, as needed. The dosing solution (50 µL) was delivered into the stomachs of 2-4 day old mice (3 per dosing group) using a plastic tube attached to the needle of a 1 mL tuberculin syringe. After 3 hours, the animals were sacrificed and dissected to determine the individual weights of the intestines and the rest of the carcass, respectively.

Results:

FIG. 24 shows a bar graph of the results from a mouse intestinal secretion assay (as described above) of peptide A (SEQ ID NO 60) compared to linaclotide (SEQ ID NO 40). In this assay peptide A had better activity than linaclotide.

FIG. 25 shows a the activity of peptide A (SEQ ID NO 60) compared to STa peptide (SEQ ID NO 28) in the mouse intestinal secretion assay, as described above. In this experiment peptide A had higher activity than the STa peptide.

FIG. 26 shows a the activity of peptidase A (SEQ ID NO 60), B (SEQ ID NO 61) and D (SEQ ID NO 63), compared to STa peptide (SEQ ID NO 28) and linaclotide (SEQ ID NO 40) in the mouse intestinal secretion assay, as described above. In this experiment peptide A had higher activity than the STa peptide. In this experiment, peptides A and D had higher activity than STa, while peptide B and linaclotide had lower activity.

HPLC Analysis of the Peptides

The peptides were analyzed through standard HPCL and LCMS methodologies. FIGS. 27 to 30 shows chromatograms of peptides A through D (SEQ ID NO 60 through 63). HPLC analysis: The peptides were analyzed by standard High Performance Liquid Chromatography (HPLC) using a Vydac C18 column (4.6 mm×150 mm, 5 microns) with a Tri Fluoro Acetic acid buffer system at 30° C.

Results:

FIG. 27 shows the HPCL analysis of peptide A (SEQ ID NO 60). The analysis shows only one significant peak in the sample and indicate that the peptide is 98% pure.

FIG. 28 shows the HPCL analysis of peptide B (SEQ ID NO 61). The analysis shows only one significant peak in the sample and indicate that the peptide is 97% pure.

FIG. 29 shows the HPCL analysis of peptide C (SEQ ID NO 62). The analysis shows only one significant peak in the sample and indicate that the peptide is 95% pure.

FIG. 30 shows the HPCL analysis of peptide D (SEQ ID NO 63). The analysis shows only one significant peak in the sample and indicate that the peptide is 99% pure.

SEQUENCE LISTING (2543 sequences)

SEQ ID NO: 1 - protein, 15 aa, Homo sapiens
PGTCEICAYAACTGC

SEQ ID NO: 2 - protein, 15 aa, Pan troglodytes
PGTCEICAYAACTGC

SEQ ID NO: 3 - protein, 15 aa, Macaca mulatta
PSTCEICAYAACTGC

SEQ ID NO: 4 - protein, 15 aa, Rattus norvegicus
PNTCEICAYAACTGC

SEQ ID NO: 5 - protein, 15 aa, Mus musculus
PNTCEICAYAACTGC

SEQ ID NO: 6 - protein, 15 aa, Sus scrofa
PSTCEICAYAACAGC

SEQ ID NO: 7 - protein, 15 aa, Bos taurus
PSTCEICAYAACAGC

SEQ ID NO: 8 - protein, 15 aa, Ovis aries
PSTCEICAYAACAGC

SEQ ID NO: 9 - protein, 15 aa, Canis lupus
PRSCEICAFAACAGC

SEQ ID NO: 10 - protein, 15 aa, Equus caballus
PRMCEICAFAACAGC

SEQ ID NO: 11 - protein, 15 aa, Ailuropoda melanoleuca
PSVCEICAFAACAGC

SEQ ID NO: 12 - protein, 15 aa, Monodelphis domestica
SHTCEICAFAACAGC

SEQ ID NO: 13 - protein, 16 aa, Ornithorhynchus anatinus
DDLCELCAFAACTGCY

SEQ ID NO: 14 - protein, 16 aa, Homo sapiens
NDDCELCVNVACTGCL

SEQ ID NO: 15 - protein, 16 aa, Pan troglodytes
NDDCELCVNVACTGCL

SEQ ID NO: 16 - protein, 16 aa, Macaca mulatta
NDDCELCVNVACTGCL

SEQ ID NO: 17 - protein, 16 aa, Equus caballus
NDDCELCVNVACTGCL

SEQ ID NO: 18 - protein, 16 aa, Bos taurus
NDDCELCVNVACTGCS

SEQ ID NO: 19 - protein, 16 aa, Sus scrofa
GDDCELCVNVACTGCS

SEQ ID NO: 20 - protein, 15 aa, Cavia porcellus
NDECELCVNIACTGC

SEQ ID NO: 21 - protein, 15 aa, Rattus norvegicus
TDECELCINVACTGC

SEQ ID NO: 22 - protein, 15 aa, Mus musculus
TDECELCINVACTGC

SEQ ID NO: 23 - protein, 15 aa, Ovis aries
DDDCELCVNVACTGC

SEQ ID NO: 24 - protein, 15 aa, Notomys alexis
TDECELCINVACTGC

SEQ ID NO: 25 - protein, 15 aa, Didelphis virginiana
QEDCELCINVACTGC

SEQ ID NO: 26 - protein, 15 aa, Monodelphis domestica
QDDCEICINVACTGC

SEQ ID NO: 27 - protein, 16 aa, Ornithorhynchus anatinus
NDDCELCTNAACTGCY

SEQ ID NO: 28 - protein, 18 aa, Escherichia coli
NTFYCCELCCNPACAGCY

SEQ ID NO: 29 - protein, 18 aa, Escherichia coli
NTFYCCELCCNPACTGCY

SEQ ID NO: 30 - protein, 19 aa, Escherichia coli
NSSNYCCELCCNPACTGCY

SEQ ID NO: 31 - protein, 18 aa, Vibrio cholerae
NTIDCCEICCNPFCTGCL

SEQ ID NO: 32 - protein, 18 aa, Vibrio mimicus
NTIDCCEICCNPFCTGCL

SEQ ID NO: 33 - protein, 18 aa, Vibrio cholerae
NLIDCCEICCNPFCTGCL

SEQ ID NO: 34 - protein, 19 aa, Vibrio cholerae
GNLIDCCEICCNPFCTGCL

SEQ ID NO: 35 - protein, 18 aa, Yersinia enterocolitica
VSSDWDCDVCCNPACTGC

SEQ ID NO: 36 - protein, 18 aa, Yersinia enterocolitica
EENDDWCEVCCNPACTGC

SEQ ID NO: 37 - protein, 18 aa, Yersinia enterocolitica
GENWDWCELCCNPACTGC

SEQ ID NO: 38 - protein, 17 aa, Citrobacter freundii
NNTTYCELCCNPACTGC

SEQ ID NO: 39 - protein, 16 aa, Artificial Sequence
  Synthesized
NDECELCVNVACTGCL

SEQ ID NO: 40 - protein, 14 aa, Artificial Sequence
  Synthesized
CCEYCCNPACTGCY

SEQ ID NO: 41 - protein, 13 aa, Artificial Sequence
  Synthesized
  Modified Amino Acid (3)..(4): Xaa can be any of several different amino acids.
  Modified Amino Acid (7)..(9): Xaa can be any of several different amino acids.
  Modified Amino Acid (11)..(12): Xaa can be any of several different amino acids.
CCXXCCXXXCXXC

SEQ ID NO: 42 - protein, 13 aa, Artificial Sequence
  Synthesized
CCETCCNPACAGC

SEQ ID NO: 43 - protein, 13 aa, Artificial Sequence
  Synthesized
  Modified Amino Acid (4)..(4): Xaa4 = norLeu = Norleucine, Nle
CCEXCCNPACAGC

SEQ ID NO: 44 - protein, 13 aa, Artificial Sequence
  Synthesized
  Modified Amino Acid (1)..(1): Xaa1 = D-Cys = D-Cysteine
XCETCCNPACAGC

SEQ ID NO: 45 - protein, 13 aa, Artificial Sequence
  Synthesized
  Modified Amino Acid (1)..(1): Xaa1 = D-Cys = D-Cysteine
XCELCCNPACAGC

SEQ ID NO: 46 - protein, 13 aa, Artificial Sequence
  Synthesized
  Modified Amino Acids (1)..(1): Xaa1 = D-Cys = D-Cysteine
  Modified Amino Acids (4)..(4): Xaa4 = norLeu = Norleucine, Nle
XCEXCCNPACAGC

SEQ ID NO: 47 - protein, 13 aa, Artificial Sequence
  Synthesized
  Modified Amino Acid (1)..(1): Xaa1 = D-Pen = D-Penicillamine
XCETCCNPACAGC

SEQ ID NO: 48 - protein, 13 aa, Artificial Sequence
  Synthesized
  Modified Amino Acid (1)..(1): Xaa1 = D-Pen = D-Penicillamine
XCELCCNPACAGC

SEQ ID NO: 49 - protein, 13 aa, Artificial Sequence
  Synthesized
  Modified Amino Acids (1)..(1): Xaa1 = D-Pen = D-Penicillamine
  Modified Amino Acids (4)..(4): Xaa4 = norLeu = Norleucine, Nle
XCEXCCNPACAGC

SEQ ID NO: 50 - protein, 13 aa, Artificial Sequence
  Synthesized
  Modified Amino Acid (1)..(1): Xaa1 = Pen = L-Penicillamine
XCETCCNPACAGC

SEQ ID NO: 51 - protein, 13 aa, Artificial Sequence
  Synthesized
  Modified Amino Acid (1)..(1): Xaa1 = Pen = L-Penicillamine
XCELCCNPACAGC

SEQ ID NO: 52 - protein, 13 aa, Artificial Sequence
  Synthesized
  Modified Amino Acids (1)..(1): Xaa1 = Pen = L-Penicillamine
  Modified Amino Acids (4)..(4): Xaa4 = norLeu = Norleucine, Nle
XCEXCCNPACAGC

SEQ ID NO: 53 - protein, 13 aa, Artificial Sequence
  Synthesized
  Modified Amino Acids (1)..(1): amino acid in position 1 can be D or L-Cysteine, or D or L-Penicillamine;
  Modified Amino Acids (4)..(4): amino acid in position 4 can be L-Leucine, L-NorLeucine, or L-Threonine
XCEXCCNPACAGC

SEQ ID NO: 54-58 - skipped (5 entries)

SEQ ID NO: 59 - protein, 19 aa, Artificial Sequence
  Synthesized
  Modified Amino Acid (12)..(12): Xaa12 = HyPro = Hydroxy-Proline, Hyp, Hydroxyproline
NTFYCCETCCNXACAGCYY

SEQ ID NO: 60 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACAGCY

SEQ ID NO: 61 - protein, 14 aa, Artificial Sequence
  Synthesized
CCETCCNPACAGCY

SEQ ID NO: 62 - protein, 14 aa, Artificial Sequence
  Synthesized
  Modified Amino Acid (8)..(8): Xaa8 = HyPro = Hydroxy-Proline, Hyp, Hydroxyproline
CCELCCNXACAGCY

SEQ ID NO: 63 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACAGCY

SEQ ID NO: 64 - protein, 14 aa, Artificial Sequence
  Synthesized
  Modified Amino Acid (8)..(8): Xaa8 = HyPro = Hydroxy-Proline, Hyp, Hydroxyproline
CCETCCNXACAGCY

SEQ ID NO: 65 - protein, 18 aa, Artificial Sequence
  Synthesized
  Modified Amino Acid (12)..(12): Xaa12 = Dhp = 3,4,-dihydro-Proline, D-Pro 3,4-Dehydroproline
NTFYCCELCCNXACAGCY

SEQ ID NO: 66 - protein, 18 aa, Artificial Sequence
  Synthesized
NTFYCCETCCNPACAGCY

SEQ ID NO: 67 - protein, 18 aa, Artificial Sequence
  Synthesized
  Modified Amino Acid (12)..(12): Xaa12 = HyPro = Hydroxy-Proline, Hyp, Hydroxyproline
NTFYCCELCCNXACAGCY

SEQ ID NO: 68 - protein, 18 aa, Artificial Sequence
  Synthesized
  Modified Amino Acid (12)..(12): Xaa12 = Thz = Thiazolidine (4-thiazolidine-2-carboxylic acid), Tzd
NTFYCCELCCNXACAGCY

SEQ ID NO: 69 - protein, 18 aa, Artificial Sequence
  Synthesized
  Modified Amino Acid (12)..(12): Xaa12 = HyPro = Hydroxy-Proline, Hyp, Hydroxyproline
NTFYCCETCCNXACAGCY

SEQ ID NO: 70-74 - skipped (5 entries)

SEQ ID NO: 75 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACAGCY

SEQ ID NO: 76 - protein, 14 aa, Artificial Sequence
  Synthesized
CCETCCNPACAGCY

SEQ ID NO: 77 - protein, 14 aa, Artificial Sequence
  Synthesized
  Modified Amino Acid (8)..(8): Xaa8 = HyPro = Hydroxy-Proline, Hyp, Hydroxyproline
CCELCCNXACAGCY

SEQ ID NO: 78 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACAGCY

SEQ ID NO: 79 - protein, 14 aa, Artificial Sequence
  Synthesized
  Modified Amino Acid (8)..(8): Xaa8 = HyPro = Hydroxy-Proline, Hyp, Hydroxyproline
CCETCCNXACAGCY

SEQ ID NO: 80-99 - skipped (20 entries)

SEQ ID NO: 100 - protein, 14 aa, Artificial Sequence
  Synthesized
CCELCCNPACAGCY

SEQ ID NO: 101 - protein, 14 aa, Artificial Sequence
  Synthesized
  Modified Amino Acid (1)..(1): Xaa1 = Mpr = 3-mercaptoproprionic acid
XCELCCNPACAGCY

SEQ ID NO: 102 - protein, 14 aa, Artificial Sequence
  Synthesized
CCSLCCNPACAGCY

SEQ ID NO: 103 - protein, 14 aa, Artificial Sequence
  Synthesized
  Modified Amino Acid (3)..(3): Xaa3 = hSer = Homoserine, Hse
CCXLCCNPACAGCY

SEQ ID NO: 104 - protein, 14 aa, Artificial Sequence
  Synthesized
  Modified Amino Acid (3)..(3): Xaa3 = Csa = Cysteic Acid
CCXLCCNPACAGCY

SEQ ID NO: 105 - protein, 14 aa, Artificial Sequence
  Synthesized
  Modified Amino Acid (4)..(4): Xaa4 = hLeu = Homoleucine, Hle
CCEXCCNPACAGCY

SEQ ID NO: 106 - protein, 14 aa, Artificial Sequence
  Synthesized
  Modified Amino Acid (4)..(4): Xaa4 = norLeu = Norleucine, Nle
CCEXCCNPACAGCY

SEQ ID NO: 107 - protein, 14 aa, Artificial Sequence
  Synthesized
  Modified Amino Acid (4)..(4): Xaa4 = ChxAla = Cyclohexyl-Aalanine, Cha
CCEXCCNPACAGCY

SEQ ID NO: 108 - protein, 14 aa, Artificial Sequence
  Synthesized
  Modified Amino Acid (4)..(4): Xaa4 = ChxIle = Cyclohexyl-Isoleucine, Chi
CCEXCCNPACAGCY

SEQ ID NO: 109 - protein, 14 aa, Artificial Sequence
  Synthesized
CCEFCCNPACAGCY

SEQ ID NO: 110 - protein, 14 aa, Artificial Sequence
  Synthesized
CCEYCCNPACAGCY

SEQ ID NO: 111 - protein, 14 aa, Artificial Sequence
  Synthesized
  Modified Amino Acid (4)..(4): Xaa4 = Dopa = L-Dopa, L-dihydroxyphenylalanine
CCEXCCNPACAGCY

SEQ ID NO: 112 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACAGCY

SEQ ID NO: 113 - protein, 14 aa, Artificial Sequence
  Synthesized
  Modified Amino Acid (8)..(8): Xaa8 = Pip = L-Pipecolic Acid
CCELCCNXACAGCY

SEQ ID NO: 114 - protein, 14 aa, Artificial Sequence
  Synthesized
CCELCCNIACAGCY

SEQ ID NO: 115 - protein, 14 aa, Artificial Sequence
  Synthesized
CCELCCNAACAGCY

SEQ ID NO: 116 - protein, 14 aa, Artificial Sequence
  Synthesized
CCELCCNPACTGCY

SEQ ID NO: 117 - protein, 14 aa, Artificial Sequence
  Synthesized
CCELCCNPACSGCY

SEQ ID NO: 118 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNPACXGCY

SEQ ID NO: 119 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNPACXGCY

SEQ ID NO: 120 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNPACXGCY

SEQ ID NO: 121 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNPACXGCY

SEQ ID NO: 122 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNPACXGCY

SEQ ID NO: 123 - protein, 14 aa, Artificial Sequence
  Synthesized
  Modified Amino Acid (12)..(12): Xaa12 = D-Ala = D-Alanine
CCELCCNPACAXCY

SEQ ID NO: 124 - protein, 14 aa, Artificial Sequence
  Synthesized
CCELCCNPACAGCI

SEQ ID NO: 125 - protein, 14 aa, Artificial Sequence
  Synthesized
CCELCCNPACAGCW

SEQ ID NO: 126-149 - skipped (24 entries)

SEQ ID NO: 150 - protein, 18 aa, Artificial Sequence
  Synthesized
NTFYCCELCCNPACAGCY

SEQ ID NO: 151 - protein, 18 aa, Artificial Sequence
  Synthesized
  Modified Amino Acid (5)..(5): Xaa5 = Mpr = 3-mercaptoproprionic acid
NTFYXCELCCNPACAGCY

SEQ ID NO: 152 - protein, 18 aa, Artificial Sequence
  Synthesized
NTFYCCSLCCNPACAGCY

SEQ ID NO: 153 - protein, 18 aa, Artificial Sequence
  Synthesized
  Modified Amino Acid (7)..(7): Xaa7 = hSer = Homoserine, Hse
NTFYCCXLCCNPACAGCY

SEQ ID NO: 154 - protein, 18 aa, Artificial Sequence
  Synthesized
  Modified Amino Acid (7)..(7): Xaa7 = Csa = Cysteic Acid
NTFYCCXLCCNPACAGCY

SEQ ID NO: 155 - protein, 18 aa, Artificial Sequence
  Synthesized
  Modified Amino Acid (8)..(8): Xaa8 = hLeu = Homoleucine, Hle
NTFYCCEXCCNPACAGCY

SEQ ID NO: 156 - protein, 14 aa, Artificial Sequence
  Synthesized
  Modified Amino Acid (4)..(4): Xaa4 = norLeu = Norleucine, Nle
CCEXCCNPACAGCY

SEQ ID NO: 157 - protein, 14 aa, Artificial Sequence
  Synthesized
  Modified Amino Acid (4)..(4): Xaa4 = ChxAla = Cyclohexyl-Aalanine, Cha
CCEXCCNPACAGCY

SEQ ID NO: 158 - protein, 14 aa, Artificial Sequence
  Synthesized
  Modified Amino Acid (4)..(4): Xaa4 = ChxIle = Cyclohexyl-Isoleucine, Chi
CCEXCCNPACAGCY

SEQ ID NO: 159 - protein, 14 aa, Artificial Sequence
  Synthesized
CCEFCCNPACAGCY

SEQ ID NO: 160 - protein, 14 aa, Artificial Sequence
  Synthesized
CCEYCCNPACAGCY

SEQ ID NO: 161 - protein, 14 aa, Artificial Sequence
  Synthesized
  Modified Amino Acid (4)..(4): Xaa4 = Dopa = L-Dopa, L-dihydroxyphenylalanine
CCEXCCNPACAGCY

SEQ ID NO: 162 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACAGCY

SEQ ID NO: 163 - protein, 14 aa, Artificial Sequence
  Synthesized
  Modified Amino Acid (8)..(8): Xaa8 = Pip = L-Pipecolic Acid
CCELCCNXACAGCY

SEQ ID NO: 164 - protein, 14 aa, Artificial Sequence
  Synthesized
CCELCCNIACAGCY

SEQ ID NO: 165 - protein, 14 aa, Artificial Sequence
  Synthesized
CCELCCNAACAGCY

SEQ ID NO: 166 - protein, 14 aa, Artificial Sequence
  Synthesized
CCELCCNPACTGCY

SEQ ID NO: 167 - protein, 14 aa, Artificial Sequence
  Synthesized
CCELCCNPACSGCY

SEQ ID NO: 168 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNPACXGCY

SEQ ID NO: 169 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNPACXGCY

SEQ ID NO: 170 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNPACXGCY

SEQ ID NO: 171 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNPACXGCY

SEQ ID NO: 172 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNPACXGCY

SEQ ID NO: 173 - protein, 14 aa, Artificial Sequence
  Synthesized
  Modified Amino Acid (12)..(12): Xaa12 = D-Ala = D-Alanine
CCELCCNPACAXCY

SEQ ID NO: 174 - protein, 14 aa, Artificial Sequence
  Synthesized
CCELCCNPACAGCI

SEQ ID NO: 175 - protein, 14 aa, Artificial Sequence
  Synthesized
CCELCCNPACAGCW

SEQ ID NO: 176-199 - skipped (24 entries)

SEQ ID NO: 200 - protein, 14 aa, Artificial Sequence
  Synthesized
  Modified Amino Acids (1)..(1): Xaa1 = Pen = L-Penicillamine
  Modified Amino Acids (4)..(4): Xaa4 = norLeu = Norleucine, Nle
  Modified Amino Acids (6)..(6): Xaa6 = Pen = L-Penicillamine
XCEXCXNPACAGCY

SEQ ID NO: 201 - protein, 14 aa, Artificial Sequence
  Synthesized
  Modified Amino Acid (1)..(1): Xaa1 = Mpr = 3-mercaptoproprionic acid
XCSLCCNPACAGCY

SEQ ID NO: 202 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXLCCNPACAGCY

SEQ ID NO: 203 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXLCCNPACAGCY

SEQ ID NO: 204 - protein, 14 aa, Artificial Sequence
  Synthesized
  Modified Amino Acid (1)..(1): Xaa1 = Mpr = 3-mercaptoproprionic acid
XCETCCNPACAGCY

SEQ ID NO: 205 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
XCEXCCNPACAGCY

SEQ ID NO: 206 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCEXCCNPACAGCY

SEQ ID NO: 207 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
XCEXCCNPACAGCY

SEQ ID NO: 208 - protein, 14 aa, Artificial Sequence
  Synthesized
  Modified Amino Acids (1)..(1): Xaa1 = Mpr = 3-mercaptoproprionic acid
  Modified Amino Acids (4)..(4): aa4 = ChxIle = Cyclohexyl-Isoleucine, Chi
XCEXCCNPACAGCY

SEQ ID NO: 209 - protein, 14 aa, Artificial Sequence
  Synthesized
  Modified Amino Acid (1)..(1): Xaa1 = Mpr = 3-mercaptoproprionic acid
XCEFCCNPACAGCY

SEQ ID NO: 210 - protein, 14 aa, Artificial Sequence
  Synthesized
  Modified Amino Acid (1)..(1): Xaa1 = Mpr = 3-mercaptoproprionic acid
XCEYCCNPACAGCY

SEQ ID NO: 211 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
XCEXCCNPACAGCY

SEQ ID NO: 212 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
XCEXCCNPACAGCY

SEQ ID NO: 213 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCELCCNXACAGCY

SEQ ID NO: 214 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCELCCNXACAGCY

SEQ ID NO: 215 - protein, 14 aa, Artificial Sequence
  Synthesized
  Modified Amino Acids (1)..(1): Xaa1 = Mpr = 3-mercaptoproprionic acid
  Modified Amino Acids (1)..(1): Xaa1 = Mpr = 3-mercaptoproprionic acid
  misc_feature (8)..(8): Xaa can be any naturally occurring amino acid
XCELCCNXACAGCY

SEQ ID NO: 216 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCELCCNXACAGCY

SEQ ID NO: 217 - protein, 14 aa, Artificial Sequence
  Synthesized
  Modified Amino Acid (1)..(1): Xaa1 = Mpr = 3-mercaptoproprionic acid
XCELCCNIACAGCY

SEQ ID NO: 218 - protein, 14 aa, Artificial Sequence
  Synthesized
  Modified Amino Acid (1)..(1): Xaa1 = Mpr = 3-mercaptoproprionic acid
XCELCCNAACAGCY

SEQ ID NO: 219 - protein, 14 aa, Artificial Sequence
  Synthesized
  Modified Amino Acid (1)..(1): Xaa1 = Mpr = 3-mercaptoproprionic acid
XCELCCNPACTGCY

SEQ ID NO: 220 - protein, 14 aa, Artificial Sequence
  Synthesized
  Modified Amino Acid (1)..(1): Xaa1 = Mpr = 3-mercaptoproprionic acid
XCELCCNPACSGCY

SEQ ID NO: 221 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCELCCNPACXGCY

SEQ ID NO: 222 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCELCCNPACXGCY

SEQ ID NO: 223 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCELCCNPACXGCY

SEQ ID NO: 224 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCELCCNPACXGCY

SEQ ID NO: 225 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCELCCNPACXGCY

SEQ ID NO: 226 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCELCCNPACAXCY

SEQ ID NO: 227 - protein, 14 aa, Artificial Sequence
  Synthesized
  Modified Amino Acid (1)..(1): Xaa1 = Mpr = 3-mercaptoproprionic acid
XCELCCNPACAGCI

SEQ ID NO: 228 - protein, 14 aa, Artificial Sequence
  Synthesized
  Modified Amino Acid (1)..(1): Xaa1 = Mpr = 3-mercaptoproprionic acid
XCELCCNPACAGCW

SEQ ID NO: 229 - protein, 14 aa, Artificial Sequence
  Synthesized
CCSTCCNPACAGCY

SEQ ID NO: 230 - protein, 14 aa, Artificial Sequence
  Synthesized
  Modified Amino Acid (4)..(4): Xaa4 = hLeu = Homoleucine, Hle
CCSXCCNPACAGCY

SEQ ID NO: 231 - protein, 14 aa, Artificial Sequence
  Synthesized
  Modified Amino Acid (4)..(4): Xaa4 = norLeu = Norleucine, Nle
CCSXCCNPACAGCY

SEQ ID NO: 232 - protein, 14 aa, Artificial Sequence
  Synthesized
  Modified Amino Acid (4)..(4): Xaa4 = ChxAla = Cyclohexyl-Aalanine, Cha
CCSXCCNPACAGCY

SEQ ID NO: 233 - protein, 14 aa, Artificial Sequence
  Synthesized
  Modified Amino Acid (4)..(4): Xaa4 = ChxIle = Cyclohexyl-Isoleucine, Chi
CCSXCCNPACAGCY

SEQ ID NO: 234 - protein, 14 aa, Artificial Sequence
  Synthesized
CCSFCCNPACAGCY

SEQ ID NO: 235 - protein, 14 aa, Artificial Sequence
  Synthesized
CCSYCCNPACAGCY

SEQ ID NO: 236 - protein, 14 aa, Artificial Sequence
  Synthesized
  Modified Amino Acid (4)..(4): Xaa4 = Dopa = L-Dopa, L-dihydroxyphenylalanine
CCSXCCNPACAGCY

SEQ ID NO: 237 - protein, 14 aa, Artificial Sequence
  Synthesized
  Modified Amino Acid (4)..(4): Xaa4 = NMe-Leu = N-methyl-leucine, MeLeu, N-Methylleucine
CCSXCCNPACAGCY

SEQ ID NO: 238 - protein, 14 aa, Artificial Sequence
  Synthesized
  Modified Amino Acid (3)..(3): Xaa3 = hSer = Homoserine, Hse
CCXTCCNPACAGCY

SEQ ID NO: 239 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
CCXXCCNPACAGCY

SEQ ID NO: 240 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
CCXXCCNPACAGCY

SEQ ID NO: 241 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
CCXXCCNPACAGCY

SEQ ID NO: 242 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
CCXXCCNPACAGCY

SEQ ID NO: 243 - protein, 14 aa, Artificial Sequence
  Synthesized
  Modified Amino Acid (3)..(3): Xaa3 = hSer = Homoserine, Hse
CCXFCCNPACAGCY

SEQ ID NO: 244 - protein, 14 aa, Artificial Sequence
  Synthesized
  Modified Amino Acid (3)..(3): Xaa3 = hSer = Homoserine, Hse
CCXYCCNPACAGCY

SEQ ID NO: 245 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
CCXXCCNPACAGCY

SEQ ID NO: 246 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
CCXXCCNPACAGCY

SEQ ID NO: 247 - protein, 13 aa, Artificial Sequence
  Synthesized
  Modified Amino Acid (2)..(2): Xaa2 = Csa = Cysteic Acid
TXTCCNPACAGCY

SEQ ID NO: 248 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
CCXXCCNPACAGCY

SEQ ID NO: 249 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
CCXXCCNPACAGCY

SEQ ID NO: 250 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
CCXXCCNPACAGCY

SEQ ID NO: 251 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
CCXXCCNPACAGCY

SEQ ID NO: 252 - protein, 14 aa, Artificial Sequence
  Synthesized
  Modified Amino Acid (3)..(3): Xaa3 = Csa = Cysteic Acid
CCXFCCNPACAGCY

SEQ ID NO: 253 - protein, 14 aa, Artificial Sequence
  Synthesized
  Modified Amino Acid (3)..(3): Xaa3 = Csa = Cysteic Acid
CCXYCCNPACAGCY

SEQ ID NO: 254 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
CCXXCCNPACAGCY

SEQ ID NO: 255 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
CCXXCCNPACAGCY

SEQ ID NO: 256 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCSLCCNXACAGCY

SEQ ID NO: 257 - protein, 14 aa, Artificial Sequence
  Synthesized
  Modified Amino Acid (8)..(8): Xaa8 = Thz = Thiazolidine (4-thiazolidine-2-carboxylic acid), Tzd
CCSLCCNXACAGCY

SEQ ID NO: 258 - protein, 14 aa, Artificial Sequence
  Synthesized
  Modified Amino Acid (8)..(8): Xaa8 = HyPro = Hydroxy-Proline, Hyp, Hydroxyproline
CCSLCCNXACAGCY

SEQ ID NO: 259 - protein, 14 aa, Artificial Sequence
  Synthesized
  Modified Amino Acid (8)..(8): Xaa8 = Pip = L-Pipecolic Acid
CCSLCCNXACAGCY

SEQ ID NO: 260 - protein, 14 aa, Artificial Sequence
  Synthesized
CCSLCCNIACAGCY

SEQ ID NO: 261 - protein, 14 aa, Artificial Sequence
  Synthesized
CCSLCCNAACAGCY

SEQ ID NO: 262 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
CCXLCCNXACAGCY

SEQ ID NO: 263 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
CCXLCCNXACAGCY

SEQ ID NO: 264 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
CCXLCCNXACAGCY

SEQ ID NO: 265 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
CCXLCCNXACAGCY

SEQ ID NO: 266 - protein, 14 aa, Artificial Sequence
  Synthesized
  Modified Amino Acid (3)..(3): Xaa3 = hSer = Homoserine, Hse
CCXLCCNIACAGCY

SEQ ID NO: 267 - protein, 14 aa, Artificial Sequence
  Synthesized
  Modified Amino Acid (3)..(3): Xaa3 = hSer = Homoserine, Hse
CCXLCCNAACAGCY

SEQ ID NO: 268 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
CCXLCCNXACAGCY

SEQ ID NO: 269 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
CCXLCCNXACAGCY

SEQ ID NO: 270 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
CCXLCCNXACAGCY

SEQ ID NO: 271 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
CCXLCCNXACAGCY

SEQ ID NO: 272 - protein, 14 aa, Artificial Sequence
  Synthesized
  Modified Amino Acid (3)..(3): Xaa3 = Csa = Cysteic Acid
CCXLCCNIACAGCY

SEQ ID NO: 273 - protein, 14 aa, Artificial Sequence
  Synthesized
  Modified Amino Acid (3)..(3): Xaa3 = Csa = Cysteic Acid
CCXLCCNAACAGCY

SEQ ID NO: 274 - protein, 14 aa, Artificial Sequence
  Synthesized
CCSLCCNPACTGCY

SEQ ID NO: 275 - protein, 14 aa, Artificial Sequence
  Synthesized
CCSLCCNPACSGCY

SEQ ID NO: 276 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCSLCCNPACXGCY

SEQ ID NO: 277 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCSLCCNPACXGCY

SEQ ID NO: 278 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCSLCCNPACXGCY

SEQ ID NO: 279 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCSLCCNPACXGCY

SEQ ID NO: 280 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCSLCCNPACXGCY

SEQ ID NO: 281 - protein, 14 aa, Artificial Sequence
  Synthesized
  Modified Amino Acid (3)..(3): Xaa3 = hSer = Homoserine, Hse
CCXLCCNPACTGCY

SEQ ID NO: 282 - protein, 14 aa, Artificial Sequence
  Synthesized
  Modified Amino Acid (3)..(3): Xaa3 = hSer = Homoserine, Hse
CCXLCCNPACSGCY

SEQ ID NO: 283 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
CCXLCCNPACXGCY

SEQ ID NO: 284 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
CCXLCCNPACXGCY

SEQ ID NO: 285 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
CCXLCCNPACXGCY

SEQ ID NO: 286 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
CCXLCCNPACXGCY

SEQ ID NO: 287 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
CCXLCCNPACXGCY

SEQ ID NO: 288 - protein, 14 aa, Artificial Sequence
  Synthesized
  Modified Amino Acid (3)..(3): Xaa3 = Csa = Cysteic Acid
CCXLCCNPACTGCY

SEQ ID NO: 289 - protein, 14 aa, Artificial Sequence
  Synthesized
  Modified Amino Acid (3)..(3): Xaa3 = Csa = Cysteic Acid
CCXLCCNPACSGCY

SEQ ID NO: 290 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
CCXLCCNPACXGCY

SEQ ID NO: 291 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
CCXLCCNPACXGCY

SEQ ID NO: 292 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
CCXLCCNPACXGCY

SEQ ID NO: 293 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
CCXLCCNPACXGCY

SEQ ID NO: 294 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
CCXLCCNPACXGCY

SEQ ID NO: 295 - protein, 14 aa, Artificial Sequence
  Synthesized
  Modified Amino Acid (12)..(12): Xaa12 = D-Ala = D-Alanine
CCSLCCNPACAXCY

SEQ ID NO: 296 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXLCCNPACAXCY

SEQ ID NO: 297 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXLCCNPACAXCY

SEQ ID NO: 298 - protein, 14 aa, Artificial Sequence
  Synthesized
CCSLCCNPACAGCI

SEQ ID NO: 299 - protein, 14 aa, Artificial Sequence
  Synthesized
CCSLCCNPACAGCW

SEQ ID NO: 300 - protein, 14 aa, Artificial Sequence
  Synthesized
  Modified Amino Acid (3)..(3): Xaa3 = hSer = Homoserine, Hse
CCXLCCNPACAGCI

SEQ ID NO: 301 - protein, 14 aa, Artificial Sequence
  Synthesized
  Modified Amino Acid (3)..(3): Xaa3 = hSer = Homoserine, Hse
CCXLCCNPACAGCW

SEQ ID NO: 302 - protein, 14 aa, Artificial Sequence
  Synthesized
  Modified Amino Acid (3)..(3): Xaa3 = Csa = Cysteic Acid
CCXLCCNPACAGCI

SEQ ID NO: 303 - protein, 14 aa, Artificial Sequence
  Synthesized
  Modified Amino Acid (3)..(3): Xaa3 = Csa = Cysteic Acid
CCXLCCNPACAGCW

SEQ ID NO: 304 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCETCCNXACAGCY

SEQ ID NO: 305 - protein, 14 aa, Artificial Sequence
  Synthesized
  Modified Amino Acid (8)..(8): Xaa8 = Thz = Thiazolidine (4-thiazolidine-2-carboxylic acid), Tzd
CCETCCNXACAGCY

SEQ ID NO: 306 - protein, 14 aa, Artificial Sequence
  Synthesized
  Modified Amino Acid (8)..(8): Xaa8 = HyPro = Hydroxy-Proline, Hyp, Hydroxyproline
CCETCCNXACAGCY

SEQ ID NO: 307 - protein, 14 aa, Artificial Sequence
  Synthesized
  Modified Amino Acid (8)..(8): Xaa8 = Pip = L-Pipecolic Acid
CCETCCNXACAGCY

SEQ ID NO: 308 - protein, 14 aa, Artificial Sequence
  Synthesized
CCETCCNIACAGCY

SEQ ID NO: 309 - protein, 14 aa, Artificial Sequence
  Synthesized
CCETCCNAACAGCY

SEQ ID NO: 310 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
CCEXCCNXACAGCY

SEQ ID NO: 311 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
CCEXCCNXACAGCY

SEQ ID NO: 312 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
CCEXCCNXACAGCY

SEQ ID NO: 313 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
CCEXCCNXACAGCY

SEQ ID NO: 314 - protein, 14 aa, Artificial Sequence
  Synthesized
  Modified Amino Acid (4)..(4): Xaa4 = hLeu = Homoleucine, Hle
CCEXCCNIACAGCY

SEQ ID NO: 315 - protein, 14 aa, Artificial Sequence
  Synthesized
  Modified Amino Acid (4)..(4): Xaa4 = hLeu = Homoleucine, Hle
CCEXCCNAACAGCY

SEQ ID NO: 316 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
CCEXCCNXACAGCY

SEQ ID NO: 317 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
CCEXCCNXACAGCY

SEQ ID NO: 318 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
CCEXCCNXACAGCY

SEQ ID NO: 319 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
CCEXCCNXACAGCY

SEQ ID NO: 320 - protein, 14 aa, Artificial Sequence
  Synthesized
  Modified Amino Acid (4)..(4): Xaa4 = norLeu = Norleucine, Nle
CCEXCCNIACAGCY

SEQ ID NO: 321 - protein, 14 aa, Artificial Sequence
  Synthesized
  Modified Amino Acid (4)..(4): Xaa4 = norLeu = Norleucine, Nle
CCEXCCNAACAGCY

SEQ ID NO: 322 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
CCEXCCNXACAGCY

SEQ ID NO: 323 - protein, 14 aa, Artificial Sequence
  Synthesized
  Modified Amino Acids (4)..(4): Xaa4 = ChxAla = Cyclohexyl-Aalanine, Cha
  Modified Amino Acids (4)..(4): Xaa8 = Thz = Thiazolidine (4-thiazolidine-2-carboxylic acid), Tzd
  misc_feature (8)..(8): Xaa can be any naturally occurring amino acid
CCEXCCNXACAGCY

SEQ ID NO: 324 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
CCEXCCNXACAGCY

SEQ ID NO: 325 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
CCEXCCNXACAGCY

SEQ ID NO: 326 - protein, 14 aa, Artificial Sequence
  Synthesized
  Modified Amino Acid (4)..(4): Xaa4 = ChxAla = Cyclohexyl-Aalanine, Cha
CCEXCCNIACAGCY

SEQ ID NO: 327 - protein, 14 aa, Artificial Sequence
  Synthesized
  Modified Amino Acid (4)..(4): Xaa4 = ChxAla = Cyclohexyl-Aalanine, Cha
CCEXCCNAACAGCY

SEQ ID NO: 328 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
CCEXCCNXACAGCY

SEQ ID NO: 329 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
CCEXCCNXACAGCY

SEQ ID NO: 330 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
CCEXCCNXACAGCY

SEQ ID NO: 331 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
CCEXCCNXACAGCY

SEQ ID NO: 332 - protein, 14 aa, Artificial Sequence
  Synthesized
  Modified Amino Acid (4)..(4): Xaa4 = ChxIle = Cyclohexyl-Isoleucine, Chi
CCEXCCNIACAGCY

SEQ ID NO: 333 - protein, 14 aa, Artificial Sequence
  Synthesized
  Modified Amino Acid (4)..(4): Xaa4 = ChxIle = Cyclohexyl-Isoleucine, Chi
CCEXCCNAACAGCY

SEQ ID NO: 334 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEFCCNXACAGCY

SEQ ID NO: 335 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEFCCNXACAGCY

SEQ ID NO: 336 - protein, 14 aa, Artificial Sequence
  Synthesized
  Modified Amino Acid (8)..(8): Xaa8 = HyPro = Hydroxy-Proline, Hyp, Hydroxyproline
CCEFCCNXACAGCY

SEQ ID NO: 337 - protein, 14 aa, Artificial Sequence
  Synthesized
  Modified Amino Acid (8)..(8): Xaa8 = Pip = L-Pipecolic Acid
CCEFCCNXACAGCY

SEQ ID NO: 338 - protein, 14 aa, Artificial Sequence
  Synthesized
CCEFCCNIACAGCY

SEQ ID NO: 339 - protein, 14 aa, Artificial Sequence
  Synthesized
CCEFCCNAACAGCY

SEQ ID NO: 340 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEYCCNXACAGCY

SEQ ID NO: 341 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEYCCNXACAGCY

SEQ ID NO: 342 - protein, 14 aa, Artificial Sequence
  Synthesized
  Modified Amino Acid (8)..(8): Xaa8 = HyPro = Hydroxy-Proline, Hyp, Hydroxyproline
CCEYCCNXACAGCY

SEQ ID NO: 343 - protein, 14 aa, Artificial Sequence
  Synthesized
  Modified Amino Acid (8)..(8): Xaa8 = Pip = L-Pipecolic Acid
CCEYCCNXACAGCY

SEQ ID NO: 344 - protein, 14 aa, Artificial Sequence
  Synthesized
CCEYCCNIACAGCY

SEQ ID NO: 345 - protein, 14 aa, Artificial Sequence
  Synthesized
CCEYCCNAACAGCY

SEQ ID NO: 346 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
CCEXCCNXACAGCY

SEQ ID NO: 347 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
CCEXCCNXACAGCY

SEQ ID NO: 348 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
CCEXCCNXACAGCY

SEQ ID NO: 349 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
CCEXCCNXACAGCY

SEQ ID NO: 350 - protein, 14 aa, Artificial Sequence
  Synthesized
  Modified Amino Acid (4)..(4): Xaa4 = Dopa = L-Dopa, L-dihydroxyphenylalanine
CCEXCCNIACAGCY

SEQ ID NO: 351 - protein, 14 aa, Artificial Sequence
  Synthesized
  Modified Amino Acid (4)..(4): Xaa4 = Dopa = L-Dopa, L-dihydroxyphenylalanine
CCEXCCNAACAGCY

SEQ ID NO: 352 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
CCEXCCNXACAGCY

SEQ ID NO: 353 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
CCEXCCNXACAGCY

SEQ ID NO: 354 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
CCEXCCNXACAGCY

SEQ ID NO: 355 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
CCEXCCNXACAGCY

SEQ ID NO: 356 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNIACAGCY

SEQ ID NO: 357 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNAACAGCY

SEQ ID NO: 358 - protein, 14 aa, Artificial Sequence
  Synthesized
CCETCCNPACTGCY

SEQ ID NO: 359 - protein, 14 aa, Artificial Sequence
  Synthesized
CCETCCNPACSGCY

SEQ ID NO: 360 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCETCCNPACXGCY

SEQ ID NO: 361 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCETCCNPACXGCY

SEQ ID NO: 362 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCETCCNPACXGCY

SEQ ID NO: 363 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCETCCNPACXGCY

SEQ ID NO: 364 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
CCEXCCNPACXGCY

SEQ ID NO: 365 - protein, 14 aa, Artificial Sequence
  Synthesized
  Modified Amino Acid (4)..(4): Xaa4 = hLeu = Homoleucine, Hle
CCEXCCNPACSGCY

SEQ ID NO: 366 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
CCEXCCNPACXGCY

SEQ ID NO: 367 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
CCEXCCNPACXGCY

SEQ ID NO: 368 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
CCEXCCNPACXGCY

SEQ ID NO: 369 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
CCEXCCNPACXGCY

SEQ ID NO: 370 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
CCEXCCNPACXGCY

SEQ ID NO: 371 - protein, 14 aa, Artificial Sequence
  Synthesized
  Modified Amino Acid (4)..(4): Xaa4 = norLeu = Norleucine, Nle
CCEXCCNPACTGCY

SEQ ID NO: 372 - protein, 14 aa, Artificial Sequence
  Synthesized
  Modified Amino Acid (4)..(4): Xaa4 = norLeu = Norleucine, Nle
CCEXCCNPACSGCY

SEQ ID NO: 373 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
CCEXCCNPACXGCY

SEQ ID NO: 374 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
CCEXCCNPACXGCY

SEQ ID NO: 375 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
CCEXCCNPACXGCY

SEQ ID NO: 376 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
CCEXCCNPACXGCY

SEQ ID NO: 377 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
CCEXCCNPACXGCY

SEQ ID NO: 378 - protein, 14 aa, Artificial Sequence
  Synthesized
  Modified Amino Acid (4)..(4): Xaa4 = norLeu = Norleucine, Nle
CCEXCCNPACTGCY

SEQ ID NO: 379 - protein, 14 aa, Artificial Sequence
  Synthesized
  Modified Amino Acid (4)..(4): Xaa4 = ChxAla = Cyclohexyl-Aalanine, Cha
CCEXCCNPACSGCY

SEQ ID NO: 380 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
CCEXCCNPACXGCY

SEQ ID NO: 381 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
CCEXCCNPACXGCY

SEQ ID NO: 382 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
CCEXCCNPACXGCY

SEQ ID NO: 383 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
CCEXCCNPACXGCY

SEQ ID NO: 384 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
CCEXCCNPACXGCY

SEQ ID NO: 385 - protein, 14 aa, Artificial Sequence
  Synthesized
  Modified Amino Acid (4)..(4): Xaa4 = ChxIle = Cyclohexyl-Isoleucine, Chi
CCEXCCNPACTGCY

SEQ ID NO: 386 - protein, 14 aa, Artificial Sequence
  Synthesized
  Modified Amino Acid (4)..(4): Xaa4 = ChxIle = Cyclohexyl-Isoleucine, Chi
CCEXCCNPACSGCY

SEQ ID NO: 387 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
CCEXCCNPACXGCY

SEQ ID NO: 388 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
CCEXCCNPACXGCY

SEQ ID NO: 389 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
CCEXCCNPACXGCY

SEQ ID NO: 390 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
CCEXCCNPACXGCY

SEQ ID NO: 391 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
CCEXCCNPACXGCY

SEQ ID NO: 392 - protein, 14 aa, Artificial Sequence
  Synthesized
CCEFCCNPACTGCY

SEQ ID NO: 393 - protein, 14 aa, Artificial Sequence
  Synthesized
CCEFCCNPACSGCY

SEQ ID NO: 394 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEFCCNPACXGCY

SEQ ID NO: 395 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEFCCNPACXGCY

SEQ ID NO: 396 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEFCCNPACXGCY

SEQ ID NO: 397 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEFCCNPACXGCY

SEQ ID NO: 398 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEFCCNPACXGCY

SEQ ID NO: 399 - protein, 14 aa, Artificial Sequence
  Synthesized
CCEYCCNPACTGCY

SEQ ID NO: 400 - protein, 14 aa, Artificial Sequence
  Synthesized
CCEYCCNPACSGCY

SEQ ID NO: 401 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEYCCNPACXGCY

SEQ ID NO: 402 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEYCCNPACXGCY

SEQ ID NO: 403 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEYCCNPACXGCY

SEQ ID NO: 404 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEYCCNPACXGCY

SEQ ID NO: 405 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEYCCNPACXGCY

SEQ ID NO: 406 - protein, 14 aa, Artificial Sequence
  Synthesized
  Modified Amino Acid (4)..(4): Xaa4 = Dopa = L-Dopa, L-dihydroxyphenylalanine
CCEXCCNPACTGCY

SEQ ID NO: 407 - protein, 14 aa, Artificial Sequence
  Synthesized
  Modified Amino Acid (4)..(4): Xaa4 = Dopa = L-Dopa, L-dihydroxyphenylalanine
CCEXCCNPACSGCY

SEQ ID NO: 408 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
CCEXCCNPACXGCY

SEQ ID NO: 409 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
CCEXCCNPACXGCY

SEQ ID NO: 410 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
CCEXCCNPACXGCY

SEQ ID NO: 411 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
CCEXCCNPACXGCY

SEQ ID NO: 412 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
CCEXCCNPACXGCY

SEQ ID NO: 413 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACTGCY

SEQ ID NO: 414 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACSGCY

SEQ ID NO: 415 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
CCEXCCNPACXGCY

SEQ ID NO: 416 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
CCEXCCNPACXGCY

SEQ ID NO: 417 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
CCEXCCNPACXGCY

SEQ ID NO: 418 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
CCEXCCNPACXGCY

SEQ ID NO: 419 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
CCEXCCNPACXGCY

SEQ ID NO: 420 - protein, 14 aa, Artificial Sequence
  Synthesized
  Modified Amino Acid (12)..(12): Xaa12 = D-Ala = D-Alanine
CCETCCNPACAXCY

SEQ ID NO: 421 - protein, 14 aa, Artificial Sequence
  Synthesized
  Modified Amino Acids (4)..(4): Xaa4 = hLeu = Homoleucine, Hle
  Modified Amino Acids (12)..(12): Xaa12 = D-Ala = D-Alanine
CCEXCCNPACAXCY

SEQ ID NO: 422 - protein, 14 aa, Artificial Sequence
  Synthesized
  Modified Amino Acids (4)..(4): Xaa4 = norLeu = Norleucine, Nle
  Modified Amino Acids (12)..(12): Xaa12 = D-Ala = D-Alanine
CCEXCCNPACAXCY

SEQ ID NO: 423 - protein, 14 aa, Artificial Sequence
  Synthesized
  Modified Amino Acids (4)..(4): Xaa4 = ChxAla = Cyclohexyl-Aalanine, Cha
  Modified Amino Acids (12)..(12): Xaa12 = D-Ala = D-Alanine
CCEXCCNPACAXCY

SEQ ID NO: 424 - protein, 14 aa, Artificial Sequence
  Synthesized
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCEXCCNPACAXCY

SEQ ID NO: 425 - protein, 14 aa, Artificial Sequence
  Synthesized
  Modified Amino Acid (12)..(12): Xaa12 = D-Ala = D-Alanine
CCEFCCNPACAXCY

SEQ ID NO: 426 - protein, 14 aa, Artificial Sequence
  Synthesized
  Modified Amino Acid (12)..(12): Xaa12 = D-Ala = D-Alanine
CCEYCCNPACAXCY

SEQ ID NO: 427 - protein, 14 aa, Artificial Sequence
  Synthesized
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCEXCCNPACAXCY

SEQ ID NO: 428 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCEXCCNPACAXCY

SEQ ID NO: 429 - protein, 14 aa, Artificial Sequence
  Synthesized
CCETCCNPACAGCI

SEQ ID NO: 430 - protein, 14 aa, Artificial Sequence
  Synthesized
CCETCCNPACAGCW

SEQ ID NO: 431 - protein, 14 aa, Artificial Sequence
  Synthesized
  Modified Amino Acid (4)..(4): Xaa4 = hLeu = Homoleucine, Hle
CCEXCCNPACAGCI

SEQ ID NO: 432 - protein, 14 aa, Artificial Sequence
  Synthesized
  Modified Amino Acid (4)..(4): Xaa4 = hLeu = Homoleucine, Hle
CCEXCCNPACAGCW

SEQ ID NO: 433 - protein, 14 aa, Artificial Sequence
  Synthesized
  Modified Amino Acid (4)..(4): Xaa4 = norLeu = Norleucine, Nle
CCEXCCNPACAGCI

SEQ ID NO: 434 - protein, 14 aa, Artificial Sequence
  Synthesized
  Modified Amino Acid (4)..(4): Xaa4 = norLeu = Norleucine, Nle
CCEXCCNPACAGCW

SEQ ID NO: 435 - protein, 14 aa, Artificial Sequence
  Synthesized
  Modified Amino Acid (4)..(4): Xaa4 = ChxAla = Cyclohexyl-Aalanine, Cha
CCEXCCNPACAGCI

SEQ ID NO: 436 - protein, 14 aa, Artificial Sequence
  Synthesized
  Modified Amino Acid (4)..(4): Xaa4 = ChxAla = Cyclohexyl-Aalanine, Cha
CCEXCCNPACAGCW

SEQ ID NO: 437 - protein, 14 aa, Artificial Sequence
  Synthesized
  Modified Amino Acid (4)..(4): Xaa4 = ChxIle = Cyclohexyl-Isoleucine, Chi
CCEXCCNPACAGCI

SEQ ID NO: 438 - protein, 14 aa, Artificial Sequence
  Synthesized
  Modified Amino Acid (4)..(4): Xaa4 = ChxIle = Cyclohexyl-Isoleucine, Chi
CCEXCCNPACAGCW

SEQ ID NO: 439 - protein, 14 aa, Artificial Sequence
  Synthesized
CCEFCCNPACAGCI

SEQ ID NO: 440 - protein, 14 aa, Artificial Sequence
  Synthesized
CCEFCCNPACAGCW

SEQ ID NO: 441 - protein, 14 aa, Artificial Sequence
  Synthesized
CCEYCCNPACAGCI

SEQ ID NO: 442 - protein, 14 aa, Artificial Sequence
  Synthesized
CCEYCCNPACAGCW

SEQ ID NO: 443 - protein, 14 aa, Artificial Sequence
  Synthesized
  Modified Amino Acid (4)..(4): Xaa4 = Dopa = L-Dopa, L-dihydroxyphenylalanine
CCEXCCNPACAGCI

SEQ ID NO: 444 - protein, 14 aa, Artificial Sequence
  Synthesized
  Modified Amino Acid (4)..(4): Xaa4 = Dopa = L-Dopa, L-dihydroxyphenylalanine
CCEXCCNPACAGCW

SEQ ID NO: 445 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACAGCI

SEQ ID NO: 446 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACAGCW

SEQ ID NO: 447 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACTGCY

SEQ ID NO: 448 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACSGCY

SEQ ID NO: 449 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCELCCNXACXGCY

SEQ ID NO: 450 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCELCCNXACXGCY

SEQ ID NO: 451 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCELCCNXACXGCY

SEQ ID NO: 452 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCELCCNXACXGCY

SEQ ID NO: 453 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa8 = Dhp = 3,4,-dihydro-Proline, D-Pro 3,4-Dehydroproline
CCELCCNXACXGCY

SEQ ID NO: 454 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACTGCY

SEQ ID NO: 455 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACSGCY

SEQ ID NO: 456 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCELCCNXACXGCY

SEQ ID NO: 457 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCELCCNXACXGCY

SEQ ID NO: 458 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCELCCNXACXGCY

SEQ ID NO: 459 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCELCCNXACXGCY

SEQ ID NO: 460 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCELCCNXACXGCY

SEQ ID NO: 461 - protein, 14 aa, Artificial Sequence
  Synthesized
  Modified Amino Acid (8)..(8): Xaa8 = HyPro = Hydroxy-Proline, Hyp, Hydroxyproline
CCELCCNXACTGCY

SEQ ID NO: 462 - protein, 14 aa, Artificial Sequence
  Synthesized
  Modified Amino Acid (8)..(8): Xaa8 = HyPro = Hydroxy-Proline, Hyp, Hydroxyproline
CCELCCNXACSGCY

SEQ ID NO: 463 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCELCCNXACXGCY

SEQ ID NO: 464 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCELCCNXACXGCY

SEQ ID NO: 465 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCELCCNXACXGCY

SEQ ID NO: 466 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCELCCNXACXGCY

SEQ ID NO: 467 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCELCCNXACXGCY

SEQ ID NO: 468 - protein, 14 aa, Artificial Sequence
  Synthesized
  Modified Amino Acid (8)..(8): Xaa8 = Pip = L-Pipecolic Acid
CCELCCNXACTGCY

SEQ ID NO: 469 - protein, 14 aa, Artificial Sequence
  Synthesized
  Modified Amino Acid (8)..(8): Xaa8 = Pip = L-Pipecolic Acid
CCELCCNXACSGCY

SEQ ID NO: 470 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCELCCNXACXGCY

SEQ ID NO: 471 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCELCCNXACXGCY

SEQ ID NO: 472 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCELCCNXACXGCY

SEQ ID NO: 473 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCELCCNXACXGCY

SEQ ID NO: 474 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCELCCNXACXGCY

SEQ ID NO: 475 - protein, 14 aa, Artificial Sequence
  Synthesized
CCELCCNIACTGCY

SEQ ID NO: 476 - protein, 14 aa, Artificial Sequence
  Synthesized
CCELCCNIACSGCY

SEQ ID NO: 477 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNIACXGCY

SEQ ID NO: 478 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNIACXGCY

SEQ ID NO: 479 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNIACXGCY

SEQ ID NO: 480 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNIACXGCY

SEQ ID NO: 481 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNIACXGCY

SEQ ID NO: 482 - protein, 14 aa, Artificial Sequence
  Synthesized
CCELCCNAACTGCY

SEQ ID NO: 483 - protein, 14 aa, Artificial Sequence
  Synthesized
CCELCCNAACSGCY

SEQ ID NO: 484 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNAACXGCY

SEQ ID NO: 485 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNAACXGCY

SEQ ID NO: 486 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNAACXGCY

SEQ ID NO: 487 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNAACXGCY

SEQ ID NO: 488 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNAACXGCY

SEQ ID NO: 489 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCELCCNXACAXCY

SEQ ID NO: 490 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCELCCNXACAXCY

SEQ ID NO: 491 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCELCCNXACAXCY

SEQ ID NO: 492 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCELCCNXACAXCY

SEQ ID NO: 493 - protein, 14 aa, Artificial Sequence
  Synthesized
  Modified Amino Acid (12)..(12): Xaa12 = D-Ala = D-Alanine
CCELCCNIACAXCY

SEQ ID NO: 494 - protein, 14 aa, Artificial Sequence
  Synthesized
  Modified Amino Acid (12)..(12): Xaa12 = D-Ala = D-Alanine
CCELCCNAACAXCY

SEQ ID NO: 495 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACAGCI

SEQ ID NO: 496 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACAGCI

SEQ ID NO: 497 - protein, 14 aa, Artificial Sequence
  Synthesized
  Modified Amino Acid (8)..(8): Xaa8 = HyPro = Hydroxy-Proline, Hyp, Hydroxyproline
CCELCCNXACAGCI

SEQ ID NO: 498 - protein, 14 aa, Artificial Sequence
  Synthesized
  Modified Amino Acid (8)..(8): Xaa8 = Pip = L-Pipecolic Acid
CCELCCNXACAGCI

SEQ ID NO: 499 - protein, 14 aa, Artificial Sequence
  Synthesized
CCELCCNIACAGCI

SEQ ID NO: 500 - protein, 14 aa, Artificial Sequence
  Synthesized
CCELCCNAACAGCI

SEQ ID NO: 501 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACAGCW

SEQ ID NO: 502 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACAGCW

SEQ ID NO: 503 - protein, 14 aa, Artificial Sequence
  Synthesized
  Modified Amino Acid (8)..(8): Xaa8 = HyPro = Hydroxy-Proline, Hyp, Hydroxyproline
CCELCCNXACAGCW

SEQ ID NO: 504 - protein, 14 aa, Artificial Sequence
  Synthesized
  Modified Amino Acid (8)..(8): Xaa8 = Pip = L-Pipecolic Acid
CCELCCNXACAGCW

SEQ ID NO: 505 - protein, 14 aa, Artificial Sequence
  Synthesized
CCELCCNIACAGCW

SEQ ID NO: 506 - protein, 14 aa, Artificial Sequence
  Synthesized
CCELCCNAACAGCW

SEQ ID NO: 507 - protein, 14 aa, Artificial Sequence
  Synthesized
  Modified Amino Acid (12)..(12): Xaa12 = D-Ala = D-Alanine
CCELCCNPACTXCY

SEQ ID NO: 508 - protein, 14 aa, Artificial Sequence
  Synthesized
  Modified Amino Acid (12)..(12): Xaa12 = D-Ala = D-Alanine
CCELCCNPACSXCY

SEQ ID NO: 509 - protein, 14 aa, Artificial Sequence
  Synthesized
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNPACXXCY

SEQ ID NO: 510 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNPACXXCY

SEQ ID NO: 511 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCELCCNPACXXCY

SEQ ID NO: 512 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNPACXXCY

SEQ ID NO: 513 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCELCCNPACXXCY

SEQ ID NO: 514 - protein, 14 aa, Artificial Sequence
  Synthesized
CCELCCNPACTGCI

SEQ ID NO: 515 - protein, 14 aa, Artificial Sequence
  Synthesized
CCELCCNPACSGCI

SEQ ID NO: 516 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNPACXGCI

SEQ ID NO: 517 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNPACXGCI

SEQ ID NO: 518 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNPACXGCI

SEQ ID NO: 519 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNPACXGCI

SEQ ID NO: 520 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNPACXGCI

SEQ ID NO: 521 - protein, 14 aa, Artificial Sequence
  Synthesized
CCELCCNPACTGCW

SEQ ID NO: 522 - protein, 14 aa, Artificial Sequence
  Synthesized
CCELCCNPACSGCW

SEQ ID NO: 523 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNPACXGCW

SEQ ID NO: 524 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNPACXGCW

SEQ ID NO: 525 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNPACXGCW

SEQ ID NO: 526 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNPACXGCW

SEQ ID NO: 527 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNPACXGCW

SEQ ID NO: 528 - protein, 14 aa, Artificial Sequence
  Synthesized
  Modified Amino Acid (12)..(12): Xaa12 = D-Ala = D-Alanine
CCELCCNPACAXCI

SEQ ID NO: 529 - protein, 14 aa, Artificial Sequence
  Synthesized
  Modified Amino Acid (12)..(12): Xaa12 = D-Ala = D-Alanine
CCELCCNPACAXCW

SEQ ID NO: 530-599 - skipped (70 entries)

SEQ ID NO: 600 - protein, 14 aa, Artificial Sequence
  Synthesized
  Modified Amino Acids (4)..(4): Xaa4 = norLeu = Norleucine, Nle
  Modified Amino Acids (5)..(5): Xaa5 = Pen = L-Penicillamine
  Modified Amino Acids (13)..(13): Xaa13 = Pen = L-Penicillamine
CCEXXCNPACAGXY

SEQ ID NO: 601 - protein, 14 aa, Artificial Sequence
  Synthesized
  Modified Amino Acid (1)..(1): Xaa1 = Mpr = 3-mercaptoproprionic acid
XCSTCCNPACAGCY

SEQ ID NO: 602 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
XCSXCCNPACAGCY

SEQ ID NO: 603 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCSXCCNPACAGCY

SEQ ID NO: 604 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
XCSXCCNPACAGCY

SEQ ID NO: 605 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
XCSXCCNPACAGCY

SEQ ID NO: 606 - protein, 14 aa, Artificial Sequence
  Synthesized
  Modified Amino Acid (1)..(1): Xaa1 = Mpr = 3-mercaptoproprionic acid
XCSFCCNPACAGCY

SEQ ID NO: 607 - protein, 14 aa, Artificial Sequence
  Synthesized
  Modified Amino Acid (1)..(1): Xaa1 = Mpr = 3-mercaptoproprionic acid
XCSYCCNPACAGCY

SEQ ID NO: 608 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
XCSXCCNPACAGCY

SEQ ID NO: 609 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
XCSXCCNPACAGCY

SEQ ID NO: 610 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCSLCCNXACAGCY

SEQ ID NO: 611 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCSLCCNXACAGCY

SEQ ID NO: 612 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
XCSLCCNXACAGCY

SEQ ID NO: 613 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCSLCCNXACAGCY

SEQ ID NO: 614 - protein, 14 aa, Artificial Sequence
  Synthesized
  Modified Amino Acid (1)..(1): Xaa1 = Mpr = 3-mercaptoproprionic acid
XCSLCCNIACAGCY

SEQ ID NO: 615 - protein, 14 aa, Artificial Sequence
  Synthesized
  Modified Amino Acid (1)..(1): Xaa1 = Mpr = 3-mercaptoproprionic acid
XCSLCCNAACAGCY

SEQ ID NO: 616 - protein, 14 aa, Artificial Sequence
  Synthesized
  Modified Amino Acid (1)..(1): Xaa1 = Mpr = 3-mercaptoproprionic acid
XCSLCCNPACTGCY

SEQ ID NO: 617 - protein, 14 aa, Artificial Sequence
  Synthesized
  Modified Amino Acid (1)..(1): Xaa1 = Mpr = 3-mercaptoproprionic acid
XCSLCCNPACSGCY

SEQ ID NO: 618 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCSLCCNPACXGCY

SEQ ID NO: 619 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCSLCCNPACXGCY

SEQ ID NO: 620 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCSLCCNPACXGCY

SEQ ID NO: 621 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCSLCCNPACXGCY

SEQ ID NO: 622 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCSLCCNPACXGCY

SEQ ID NO: 623 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCSLCCNPACAXCY

SEQ ID NO: 624 - protein, 14 aa, Artificial Sequence
  Synthesized
  Modified Amino Acid (1)..(1): Xaa1 = Mpr = 3-mercaptoproprionic acid
XCSLCCNPACAGCI

SEQ ID NO: 625 - protein, 14 aa, Artificial Sequence
  Synthesized
  Modified Amino Acid (1)..(1): Xaa1 = Mpr = 3-mercaptoproprionic acid
XCSLCCNPACAGCW

SEQ ID NO: 626 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXTCCNPACAGCY

SEQ ID NO: 627 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa4 = hLeu = Homoleucine, Hle
  Modified Amino Acids (4)..(4): Xaa4 = hLeu = Homoleucine, Hle
XCXXCCNPACAGCY

SEQ ID NO: 628 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (4)..(4): Xaa4 = norLeu = Norleucine, Nle
XCXXCCNPACAGCY

SEQ ID NO: 629 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (4)..(4): Xaa4 = ChxAla = Cyclohexyl-Aalanine, Cha
XCXXCCNPACAGCY

SEQ ID NO: 630 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (4)..(4): Xaa4 = ChxIle = Cyclohexyl-Isoleucine, Chi
XCXXCCNPACAGCY

SEQ ID NO: 631 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXFCCNPACAGCY

SEQ ID NO: 632 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXYCCNPACAGCY

SEQ ID NO: 633 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
XCXXCCNPACAGCY

SEQ ID NO: 634 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
XCXXCCNPACAGCY

SEQ ID NO: 635 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (8)..(8): Xaa3 = hSer = Homoserine, Hse Xaa8 = Dhp = 3,4,-dihydro-Proline, D-Pro 3,4-Dehydroproline
  Modified Amino Acids (8)..(8): Xaa8 = Dhp = 3,4,-dihydro-Proline, D-Pro 3,4-Dehydroproline
XCXLCCNXACAGCY

SEQ ID NO: 636 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
XCXLCCNXACAGCY

SEQ ID NO: 637 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
XCXLCCNXACAGCY

SEQ ID NO: 638 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (8)..(8): Xaa8 = Pip = L-Pipecolic Acid
XCXLCCNXACAGCY

SEQ ID NO: 639 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXLCCNIACAGCY

SEQ ID NO: 640 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXLCCNAACAGCY

SEQ ID NO: 641 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXLCCNPACTGCY

SEQ ID NO: 642 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXLCCNPACSGCY

SEQ ID NO: 643 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
XCXLCCNPACXGCY

SEQ ID NO: 644 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
XCXLCCNPACXGCY

SEQ ID NO: 645 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
XCXLCCNPACXGCY

SEQ ID NO: 646 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
XCXLCCNPACXGCY

SEQ ID NO: 647 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
XCXLCCNPACXGCY

SEQ ID NO: 648 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine
  Modified Amino Acids (12)..(12): Xaa12 = D-Ala = D-Alanine
XCXLCCNPACAXCY

SEQ ID NO: 649 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXLCCNPACAGCI

SEQ ID NO: 650 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = hSer = Homoserine, Hse
XCXLCCNPACAGCW

SEQ ID NO: 651 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXTCCNPACAGCY

SEQ ID NO: 652 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (4)..(4): Xaa4 = hLeu = Homoleucine, Hle
XCXXCCNPACAGCY

SEQ ID NO: 653 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (4)..(4): Xaa4 = norLeu = Norleucine, Nle
XCXXCCNPACAGCY

SEQ ID NO: 654 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (4)..(4): Xaa4 = ChxAla = Cyclohexyl-Aalanine, Cha
XCXXCCNPACAGCY

SEQ ID NO: 655 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (4)..(4): Xaa4 = ChxIle = Cyclohexyl-Isoleucine, Chi
XCXXCCNPACAGCY

SEQ ID NO: 656 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXFCCNPACAGCY

SEQ ID NO: 657 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXYCCNPACAGCY

SEQ ID NO: 658 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (4)..(4): Xaa4 = Dopa = L-Dopa, L-dihydroxyphenylalanine
XCXXCCNPACAGCY

SEQ ID NO: 659 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
XCXXCCNPACAGCY

SEQ ID NO: 660 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
XCXLCCNXACAGCY

SEQ ID NO: 661 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
XCXLCCNXACAGCY

SEQ ID NO: 662 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
XCXLCCNXACAGCY

SEQ ID NO: 663 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (8)..(8): Xaa8 = Pip = L-Pipecolic Acid
XCXLCCNXACAGCY

SEQ ID NO: 664 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXLCCNIACAGCY

SEQ ID NO: 665 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXLCCNAACAGCY

SEQ ID NO: 666 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXLCCNPACTGCY

SEQ ID NO: 667 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXLCCNPACSGCY

SEQ ID NO: 668 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
XCXLCCNPACXGCY

SEQ ID NO: 669 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
XCXLCCNPACXGCY

SEQ ID NO: 670 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
XCXLCCNPACXGCY

SEQ ID NO: 671 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
XCXLCCNPACXGCY

SEQ ID NO: 672 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
XCXLCCNPACXGCY

SEQ ID NO: 673 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
  Modified Amino Acids (12)..(12): Xaa12 = D-Ala = D-Alanine
XCXLCCNPACAXCY

SEQ ID NO: 674 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXLCCNPACAGCI

SEQ ID NO: 675 - protein, 14 aa, Artificial Sequence
  Synthesized
  Modified Amino Acids (1)..(1): Xaa1 = Mpr = 3-mercaptoproprionic acid
  Modified Amino Acids (3)..(3): Xaa3 = Csa = Cysteic Acid
XCXLCCNPACAGCW

SEQ ID NO: 676 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCETCCNXACAGCY

SEQ ID NO: 677 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCETCCNXACAGCY

SEQ ID NO: 678 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
XCETCCNXACAGCY

SEQ ID NO: 679 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCETCCNXACAGCY

SEQ ID NO: 680 - protein, 14 aa, Artificial Sequence
  Synthesized
  Modified Amino Acid (1)..(1): Xaa1 = Mpr = 3-mercaptoproprionic acid
XCETCCNIACAGCY

SEQ ID NO: 681 - protein, 14 aa, Artificial Sequence
  Synthesized
  Modified Amino Acid (1)..(1): Xaa1 = Mpr = 3-mercaptoproprionic acid
XCETCCNAACAGCY

SEQ ID NO: 682 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
XCEXCCNXACAGCY

SEQ ID NO: 683 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
XCEXCCNXACAGCY

SEQ ID NO: 684 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (8)..(8): Xaa4 = hLeu = Homoleucine, Hle Xaa8 = HyPro = Hydroxy-Proline, Hyp, Hydroxyproline
XCEXCCNXACAGCY

SEQ ID NO: 685 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (8)..(8): Xaa8 = Pip = L-Pipecolic Acid
XCEXCCNXACAGCY

SEQ ID NO: 686 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
XCEXCCNIACAGCY

SEQ ID NO: 687 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
XCEXCCNAACAGCY

SEQ ID NO: 688 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
XCEXCCNXACAGCY

SEQ ID NO: 689 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
XCEXCCNXACAGCY

SEQ ID NO: 690 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
XCEXCCNXACAGCY

SEQ ID NO: 691 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (8)..(8): Xaa8 = Pip = L-Pipecolic Acid
XCEXCCNXACAGCY

SEQ ID NO: 692 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCEXCCNIACAGCY

SEQ ID NO: 693 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCEXCCNAACAGCY

SEQ ID NO: 694 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
XCEXCCNXACAGCY

SEQ ID NO: 695 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
XCEXCCNXACAGCY

SEQ ID NO: 696 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
XCEXCCNXACAGCY

SEQ ID NO: 697 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
XCEXCCNXACAGCY

SEQ ID NO: 698 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
XCEXCCNIACAGCY

SEQ ID NO: 699 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
XCEXCCNAACAGCY

SEQ ID NO: 700 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
XCEXCCNXACAGCY

SEQ ID NO: 701 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
XCEXCCNXACAGCY

SEQ ID NO: 702 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
XCEXCCNXACAGCY

SEQ ID NO: 703 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
XCEXCCNXACAGCY

SEQ ID NO: 704 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
XCEXCCNIACAGCY

SEQ ID NO: 705 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
XCEXCCNAACAGCY

SEQ ID NO: 706 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCEFCCNXACAGCY

SEQ ID NO: 707 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCEFCCNXACAGCY

SEQ ID NO: 708 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
XCEFCCNXACAGCY

SEQ ID NO: 709 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCEFCCNXACAGCY

SEQ ID NO: 710 - protein, 14 aa, Artificial Sequence
  Synthesized
  Modified Amino Acid (1)..(1): Xaa1 = Mpr = 3-mercaptoproprionic acid
XCEFCCNIACAGCY

SEQ ID NO: 711 - protein, 14 aa, Artificial Sequence
  Synthesized
  Modified Amino Acid (1)..(1): Xaa1 = Mpr = 3-mercaptoproprionic acid
XCEFCCNAACAGCY

SEQ ID NO: 712 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCEYCCNXACAGCY

SEQ ID NO: 713 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCEYCCNXACAGCY

SEQ ID NO: 714 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
XCEYCCNXACAGCY

SEQ ID NO: 715 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCEYCCNXACAGCY

SEQ ID NO: 716 - protein, 14 aa, Artificial Sequence
  Synthesized
  Modified Amino Acid (1)..(1): Xaa1 = Mpr = 3-mercaptoproprionic acid
XCEYCCNIACAGCY

SEQ ID NO: 717 - protein, 14 aa, Artificial Sequence
  Synthesized
  Modified Amino Acid (1)..(1): Xaa1 = Mpr = 3-mercaptoproprionic acid
XCEYCCNAACAGCY

SEQ ID NO: 718 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
XCEXCCNXACAGCY

SEQ ID NO: 719 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
XCEXCCNXACAGCY

SEQ ID NO: 720 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
XCEXCCNXACAGCY

SEQ ID NO: 721 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
XCEXCCNXACAGCY

SEQ ID NO: 722 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
XCEXCCNIACAGCY

SEQ ID NO: 723 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
XCEXCCNAACAGCY

SEQ ID NO: 724 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
XCEXCCNXACAGCY

SEQ ID NO: 725 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
XCEXCCNXACAGCY

SEQ ID NO: 726 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
XCEXCCNXACAGCY

SEQ ID NO: 727 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
XCEXCCNXACAGCY

SEQ ID NO: 728 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
XCEXCCNIACAGCY

SEQ ID NO: 729 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
XCEXCCNAACAGCY

SEQ ID NO: 730 - protein, 14 aa, Artificial Sequence
  Synthesized
  Modified Amino Acid (1)..(1): Xaa1 = Mpr = 3-mercaptoproprionic acid
XCETCCNPACTGCY

SEQ ID NO: 731 - protein, 14 aa, Artificial Sequence
  Synthesized
  Modified Amino Acid (1)..(1): Xaa1 = Mpr = 3-mercaptoproprionic acid
XCETCCNPACSGCY

SEQ ID NO: 732 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCETCCNPACXGCY

SEQ ID NO: 733 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCETCCNPACXGCY

SEQ ID NO: 734 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCETCCNPACXGCY

SEQ ID NO: 735 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCETCCNPACXGCY

SEQ ID NO: 736 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCETCCNPACXGCY

SEQ ID NO: 737 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
XCEXCCNPACSGCY

SEQ ID NO: 738 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
XCEXCCNPACXGCY

SEQ ID NO: 739 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
XCEXCCNPACXGCY

SEQ ID NO: 740 - protein, 14 aa, Artificial Sequence
  Synthesized
  misc_feature (1)..(1): Xaa can be any naturally occurring amino acid
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
XCEXCCNPACXGCY

SEQ ID NO: 741 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
XCEXCCNPACXGCY

SEQ ID NO: 742 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
XCEXCCNPACXGCY

SEQ ID NO: 743 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCEXCCNPACTGCY

SEQ ID NO: 744 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCEXCCNPACSGCY

SEQ ID NO: 745 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
XCEXCCNPACXGCY

SEQ ID NO: 746 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
XCEXCCNPACXGCY

SEQ ID NO: 747 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (11)..(11): Xaa4 = norLeu = Norleucine, Nle Xaa11 = 4NO2-Phe = 4-nitro-Phenylalanine, Phe(4-NO2), 4-Nitrophenylalanine
XCEXCCNPACXGCY

SEQ ID NO: 748 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
XCEXCCNPACXGCY

SEQ ID NO: 749 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
XCEXCCNPACXGCY

SEQ ID NO: 750 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCEXCCNPACTGCY

SEQ ID NO: 751 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
XCEXCCNPACSGCY

SEQ ID NO: 752 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
XCEXCCNPACXGCY

SEQ ID NO: 753 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
XCEXCCNPACXGCY

SEQ ID NO: 754 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
XCEXCCNPACXGCY

SEQ ID NO: 755 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
XCEXCCNPACXGCY

SEQ ID NO: 756 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
XCEXCCNPACXGCY

SEQ ID NO: 757 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
XCEXCCNPACTGCY

SEQ ID NO: 758 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
XCEXCCNPACSGCY

SEQ ID NO: 759 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalaninei
XCEXCCNPACXGCY

SEQ ID NO: 760 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
XCEXCCNPACXGCY

SEQ ID NO: 761 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
XCEXCCNPACXGCY

SEQ ID NO: 762 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
XCEXCCNPACXGCY

SEQ ID NO: 763 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
XCEXCCNPACXGCY

SEQ ID NO: 764 - protein, 14 aa, Artificial Sequence
  Synthesized
  Modified Amino Acid (1)..(1): Xaa1 = Mpr = 3-mercaptoproprionic acid
XCEFCCNPACTGCY

SEQ ID NO: 765 - protein, 14 aa, Artificial Sequence
  Synthesized
  Modified Amino Acid (1)..(1): Xaa1 = Mpr = 3-mercaptoproprionic acid
XCEFCCNPACSGCY

SEQ ID NO: 766 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCEFCCNPACXGCY

SEQ ID NO: 767 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCEFCCNPACXGCY

SEQ ID NO: 768 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCEFCCNPACXGCY

SEQ ID NO: 769 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCEFCCNPACXGCY

SEQ ID NO: 770 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCEFCCNPACXGCY

SEQ ID NO: 771 - protein, 14 aa, Artificial Sequence
  Synthesized
  Modified Amino Acid (1)..(1): Xaa1 = Mpr = 3-mercaptoproprionic acid
XCEYCCNPACTGCY

SEQ ID NO: 772 - protein, 14 aa, Artificial Sequence
  Synthesized
  Modified Amino Acid (1)..(1): Xaa1 = Mpr = 3-mercaptoproprionic acid
XCEYCCNPACSGCY

SEQ ID NO: 773 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCEYCCNPACXGCY

SEQ ID NO: 774 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCEYCCNPACXGCY

SEQ ID NO: 775 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCEYCCNPACXGCY

SEQ ID NO: 776 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCEYCCNPACXGCY

SEQ ID NO: 777 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCEYCCNPACXGCY

SEQ ID NO: 778 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
XCEXCCNPACTGCY

SEQ ID NO: 779 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
XCEXCCNPACSGCY

SEQ ID NO: 780 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
XCEXCCNPACXGCY

SEQ ID NO: 781 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
XCEXCCNPACXGCY

SEQ ID NO: 782 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
XCEXCCNPACXGCY

SEQ ID NO: 783 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
XCEXCCNPACXGCY

SEQ ID NO: 784 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
XCEXCCNPACXGCY

SEQ ID NO: 785 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
XCEXCCNPACTGCY

SEQ ID NO: 786 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
XCEXCCNPACSGCY

SEQ ID NO: 787 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
XCEXCCNPACXGCY

SEQ ID NO: 788 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
XCEXCCNPACXGCY

SEQ ID NO: 789 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
XCEXCCNPACXGCY

SEQ ID NO: 790 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
XCEXCCNPACXGCY

SEQ ID NO: 791 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
XCEXCCNPACXGCY

SEQ ID NO: 792 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCETCCNPACAXCY

SEQ ID NO: 793 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
  Modified Amino Acids (12)..(12): Xaa12 = D-Ala = D-Alanine
XCEXCCNPACAXCY

SEQ ID NO: 794 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
  Modified Amino Acids (12)..(12): Xaa12 = D-Ala = D-Alanine
XCEXCCNPACAXCY

SEQ ID NO: 795 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
  Modified Amino Acids (12)..(12): Xaa12 = D-Ala = D-Alanine
XCEXCCNPACAXCY

SEQ ID NO: 796 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
  Modified Amino Acids (12)..(12): Xaa12 = D-Ala = D-Alanine
XCEXCCNPACAXCY

SEQ ID NO: 797 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCEFCCNPACAXCY

SEQ ID NO: 798 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCEYCCNPACAXCY

SEQ ID NO: 799 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
  Modified Amino Acids (12)..(12): Xaa12 = D-Ala = D-Alanine
XCEXCCNPACAXCY

SEQ ID NO: 800 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
XCEXCCNPACAXCY

SEQ ID NO: 801 - protein, 14 aa, Artificial Sequence
  Synthesized
  Modified Amino Acid (1)..(1): Xaa1 = Mpr = 3-mercaptoproprionic acid
XCETCCNPACAGCI

SEQ ID NO: 802 - protein, 14 aa, Artificial Sequence
  Synthesized
  Modified Amino Acid (1)..(1): Xaa1 = Mpr = 3-mercaptoproprionic acid
XCETCCNPACAGCW

SEQ ID NO: 803 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
XCEXCCNPACAGCI

SEQ ID NO: 804 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = hLeu = Homoleucine, Hle
XCEXCCNPACAGCW

SEQ ID NO: 805 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCEXCCNPACAGCI

SEQ ID NO: 806 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = norLeu = Norleucine, Nle
XCEXCCNPACAGCW

SEQ ID NO: 807 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
XCEXCCNPACAGCI

SEQ ID NO: 808 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxAla = Cyclohexyl-Aalanine, Cha
XCEXCCNPACAGCW

SEQ ID NO: 809 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
XCEXCCNPACAGCI

SEQ ID NO: 810 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = ChxIle = Cyclohexyl-Isoleucine, Chi
XCEXCCNPACAGCW

SEQ ID NO: 811 - protein, 14 aa, Artificial Sequence
  Synthesized
  Modified Amino Acid (1)..(1): Xaa1 = Mpr = 3-mercaptoproprionic acid
XCEFCCNPACAGCI

SEQ ID NO: 812 - protein, 14 aa, Artificial Sequence
  Synthesized
  Modified Amino Acid (1)..(1): Xaa1 = Mpr = 3-mercaptoproprionic acid
XCEFCCNPACAGCW

SEQ ID NO: 813 - protein, 14 aa, Artificial Sequence
  Synthesized
  Modified Amino Acid (1)..(1): Xaa1 = Mpr = 3-mercaptoproprionic acid
XCEYCCNPACAGCI

SEQ ID NO: 814 - protein, 14 aa, Artificial Sequence
  Synthesized
  Modified Amino Acid (1)..(1): Xaa1 = Mpr = 3-mercaptoproprionic acid
XCEYCCNPACAGCW

SEQ ID NO: 815 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
XCEXCCNPACAGCI

SEQ ID NO: 816 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = Dopa = L-Dopa, L-dihydroxyphenylalanine
XCEXCCNPACAGCW

SEQ ID NO: 817 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
XCEXCCNPACAGCI

SEQ ID NO: 818 - protein, 14 aa, Artificial Sequence
  Synthesized
  Modified Amino Acids (1)..(1): Xaa1 = Mpr = 3-mercaptoproprionic acid
  Modified Amino Acids (4)..(4): Xaa4 = NMe-Leu = N-methyl-leucine, MeLeu, N-Methylleucine
XCEXCCNPACAGCW

SEQ ID NO: 819 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCELCCNXACTGCY

SEQ ID NO: 820 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCELCCNXACSGCY

SEQ ID NO: 821 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
XCELCCNXACXGCY

SEQ ID NO: 822 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
XCELCCNXACXGCY

SEQ ID NO: 823 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
XCELCCNXACXGCY

SEQ ID NO: 824 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
XCELCCNXACXGCY

SEQ ID NO: 825 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
XCELCCNXACXGCY

SEQ ID NO: 826 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCELCCNXACTGCY

SEQ ID NO: 827 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCELCCNXACSGCY

SEQ ID NO: 828 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
XCELCCNXACXGCY

SEQ ID NO: 829 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
XCELCCNXACXGCY

SEQ ID NO: 830 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
XCELCCNXACXGCY

SEQ ID NO: 831 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
XCELCCNXACXGCY

SEQ ID NO: 832 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
XCELCCNXACXGCY

SEQ ID NO: 833 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
XCELCCNXACTGCY

SEQ ID NO: 834 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
XCELCCNXACSGCY

SEQ ID NO: 835 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
XCELCCNXACXGCY

SEQ ID NO: 836 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
XCELCCNXACXGCY

SEQ ID NO: 837 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
XCELCCNXACXGCY

SEQ ID NO: 838 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
XCELCCNXACXGCY

SEQ ID NO: 839 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
XCELCCNXACXGCY

SEQ ID NO: 840 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCELCCNXACTGCY

SEQ ID NO: 841 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCELCCNXACSGCY

SEQ ID NO: 842 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
XCELCCNXACXGCY

SEQ ID NO: 843 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
XCELCCNXACXGCY

SEQ ID NO: 844 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
XCELCCNXACXGCY

SEQ ID NO: 845 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
XCELCCNXACXGCY

SEQ ID NO: 846 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
XCELCCNXACXGCY

SEQ ID NO: 847 - protein, 14 aa, Artificial Sequence
  Synthesized
  Modified Amino Acid (1)..(1): Xaa1 = Mpr = 3-mercaptoproprionic acid
XCELCCNIACTGCY

SEQ ID NO: 848 - protein, 14 aa, Artificial Sequence
  Synthesized
  Modified Amino Acid (1)..(1): Xaa1 = Mpr = 3-mercaptoproprionic acid
XCELCCNIACSGCY

SEQ ID NO: 849 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCELCCNIACXGCY

SEQ ID NO: 850 - protein, 14 aa, Artificial Sequence
  Synthesized
  Modified Amino Acids (1)..(11): Xaa1 = Mpr = 3-mercaptoproprionic acid Xaa11 = 4MeO-Phe = 4-methoxy-Phenylalanine, Phe(4-OMe), 4-methoxyphenylalanine
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCELCCNIACXGCY

SEQ ID NO: 851 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCELCCNIACXGCY

SEQ ID NO: 852 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCELCCNIACXGCY

SEQ ID NO: 853 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCELCCNIACXGCY

SEQ ID NO: 854 - protein, 14 aa, Artificial Sequence
  Synthesized
  Modified Amino Acid (1)..(1): Xaa1 = Mpr = 3-mercaptoproprionic acid
XCELCCNAACTGCY

SEQ ID NO: 855 - protein, 14 aa, Artificial Sequence
  Synthesized
  Modified Amino Acid (1)..(1): Xaa1 = Mpr = 3-mercaptoproprionic acid
XCELCCNAACSGCY

SEQ ID NO: 856 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCELCCNAACXGCY

SEQ ID NO: 857 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCELCCNAACXGCY

SEQ ID NO: 858 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCELCCNAACXGCY

SEQ ID NO: 859 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCELCCNAACXGCY

SEQ ID NO: 860 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCELCCNAACXGCY

SEQ ID NO: 861 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
  Modified Amino Acids (12)..(12): Xaa8 = Dhp = 3,4,-dihydro-Proline, D-Pro 3,4-Dehydroproline
XCELCCNXACAXCY

SEQ ID NO: 862 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
XCELCCNXACAXCY

SEQ ID NO: 863 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
XCELCCNXACAXCY

SEQ ID NO: 864 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
  Modified Amino Acids (12)..(12): Xaa12 = D-Ala = D-Alanine
XCELCCNXACAXCY

SEQ ID NO: 865 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCELCCNIACAXCY

SEQ ID NO: 866 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCELCCNAACAXCY

SEQ ID NO: 867 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCELCCNXACAGCI

SEQ ID NO: 868 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCELCCNXACAGCI

SEQ ID NO: 869 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
XCELCCNXACAGCI

SEQ ID NO: 870 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCELCCNXACAGCI

SEQ ID NO: 871 - protein, 14 aa, Artificial Sequence
  Synthesized
  Modified Amino Acid (1)..(1): Xaa1 = Mpr = 3-mercaptoproprionic acid
XCELCCNIACAGCI

SEQ ID NO: 872 - protein, 14 aa, Artificial Sequence
  Synthesized
  Modified Amino Acid (1)..(1): Xaa1 = Mpr = 3-mercaptoproprionic acid
XCELCCNAACAGCI

SEQ ID NO: 873 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Dhp = 3,4,-dihydro-Proline, D-Pro 3,4-Dehydroproline
XCELCCNXACAGCW

SEQ ID NO: 874 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Thz = Thiazolidine (4-thiazolidine-2-carboxylic acid), Tzd
XCELCCNXACAGCW

SEQ ID NO: 875 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = HyPro = Hydroxy-Proline, Hyp, Hydroxyproline
XCELCCNXACAGCW

SEQ ID NO: 876 - protein, 14 aa, Artificial Sequence
  Synthesized
  Modified Amino Acids (1)..(1): Xaa1 = Mpr = 3-mercaptoproprionic acid
  Modified Amino Acids (8)..(8): Xaa8 = Pip = L-Pipecolic Acid
XCELCCNXACAGCW

SEQ ID NO: 877 - protein, 14 aa, Artificial Sequence
  Synthesized
  Modified Amino Acid (1)..(1): Xaa1 = Mpr = 3-mercaptoproprionic acid
XCELCCNIACAGCW

SEQ ID NO: 878 - protein, 14 aa, Artificial Sequence
  Synthesized
  Modified Amino Acid (1)..(1): Xaa1 = Mpr = 3-mercaptoproprionic acid
XCELCCNAACAGCW

SEQ ID NO: 879 - protein, 14 aa, Artificial Sequence
  Synthesized
  Modified Amino Acids (1)..(12): Xaa1 = Mpr = 3-mercaptoproprionic acid Xaa12 = D-Ala = D-Alanine
  Modified Amino Acids (1)..(1): Xaa1 = Mpr = 3-mercaptoproprionic acid
  Modified Amino Acids (12)..(12): Xaa12 = D-Ala = D-Alanine
XCELCCNPACTXCY

SEQ ID NO: 880 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCELCCNPACSXCY

SEQ ID NO: 881 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
XCELCCNPACXXCY

SEQ ID NO: 882 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
XCELCCNPACXXCY

SEQ ID NO: 883 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa11 = 4NO2-Phe = 4-nitro-Phenylalanine, Phe(4-NO2), 4-Nitrophenylalanine
XCELCCNPACXXCY

SEQ ID NO: 884 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
XCELCCNPACXXCY

SEQ ID NO: 885 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
XCELCCNPACXXCY

SEQ ID NO: 886 - protein, 14 aa, Artificial Sequence
  Synthesized
  Modified Amino Acid (1)..(1): Xaa1 = Mpr = 3-mercaptoproprionic acid
XCELCCNPACTGCI

SEQ ID NO: 887 - protein, 14 aa, Artificial Sequence
  Synthesized
  Modified Amino Acid (1)..(1): Xaa1 = Mpr = 3-mercaptoproprionic acid
XCELCCNPACSGCI

SEQ ID NO: 888 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCELCCNPACXGCI

SEQ ID NO: 889 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCELCCNPACXGCI

SEQ ID NO: 890 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCELCCNPACXGCI

SEQ ID NO: 891 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCELCCNPACXGCI

SEQ ID NO: 892 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCELCCNPACXGCI

SEQ ID NO: 893 - protein, 14 aa, Artificial Sequence
  Synthesized
  Modified Amino Acid (1)..(1): Xaa1 = Mpr = 3-mercaptoproprionic acid
XCELCCNPACTGCW

SEQ ID NO: 894 - protein, 14 aa, Artificial Sequence
  Synthesized
  Modified Amino Acid (1)..(1): Xaa1 = Mpr = 3-mercaptoproprionic acid
XCELCCNPACSGCW

SEQ ID NO: 895 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4F-Phe = 4-fluoro-Phenylalanine, Phe(4-F), 4-fluorophenylalanine
XCELCCNPACXGCW

SEQ ID NO: 896 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeO-Phe = 4-methoxy-Phenylalanine, Phe(4-OMe), 4-methoxyphenylalanine
XCELCCNPACXGCW

SEQ ID NO: 897 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4NO2-Phe = 4-nitro-Phenylalanine, Phe(4-NO2), 4-Nitrophenylalanine
XCELCCNPACXGCW

SEQ ID NO: 898 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 5F-Phe = Pentafluoro-Phenylalanine, Phe(3-F), 3-fluorophenylalanine
XCELCCNPACXGCW

SEQ ID NO: 899 - protein, 14 aa, Artificial Sequence
  Synthesized
  Modified Amino Acids (1)..(1): Xaa1 = Mpr = 3-mercaptoproprionic acid
  Modified Amino Acids (11)..(11): Xaa11 = 4MeF3-Phe = Phe(4-MeF3), 4-trifluoromethylphenylalanine
XCELCCNPACXGCW

SEQ ID NO: 900 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCELCCNPACAXCI

SEQ ID NO: 901 - protein, 14 aa, Artificial Sequence
  Synthesized
  Modified Amino Acids (1)..(1): Xaa1 = Mpr = 3-mercaptoproprionic acid
  Modified Amino Acids (12)..(12): Xaa12 = D-Ala = D-Alanine
XCELCCNPACAXCW

SEQ ID NO: 902 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCSTCCNXACAGCY

SEQ ID NO: 903 - protein, 14 aa, Artificial Sequence
  Synthesized
  Modified Amino Acid (8)..(8): Xaa8 = Thz = Thiazolidine (4-thiazolidine-2-carboxylic acid), Tzd
CCSTCCNXACAGCY

SEQ ID NO: 904 - protein, 14 aa, Artificial Sequence
  Synthesized
  Modified Amino Acid (8)..(8): Xaa8 = HyPro = Hydroxy-Proline, Hyp, Hydroxyproline
CCSTCCNXACAGCY

SEQ ID NO: 905 - protein, 14 aa, Artificial Sequence
  Synthesized
  Modified Amino Acid (8)..(8): Xaa8 = Pip = L-Pipecolic Acid
CCSTCCNXACAGCY

SEQ ID NO: 906 - protein, 14 aa, Artificial Sequence
  Synthesized
CCSTCCNIACAGCY

SEQ ID NO: 907 - protein, 14 aa, Artificial Sequence
  Synthesized
CCSTCCNAACAGCY

SEQ ID NO: 908 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
CCSXCCNXACAGCY

SEQ ID NO: 909 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
CCSXCCNXACAGCY

SEQ ID NO: 910 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
CCSXCCNXACAGCY

SEQ ID NO: 911 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
CCSXCCNXACAGCY

SEQ ID NO: 912 - protein, 14 aa, Artificial Sequence
  Synthesized
  Modified Amino Acid (4)..(4): Xaa4 = hLeu = Homoleucine, Hle
CCSXCCNIACAGCY

SEQ ID NO: 913 - protein, 14 aa, Artificial Sequence
  Synthesized
  Modified Amino Acid (4)..(4): Xaa4 = hLeu = Homoleucine, Hle
CCSXCCNAACAGCY

SEQ ID NO: 914 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
CCSXCCNXACAGCY

SEQ ID NO: 915 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
CCSXCCNXACAGCY

SEQ ID NO: 916 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
CCSXCCNXACAGCY

SEQ ID NO: 917 - protein, 14 aa, Artificial Sequence
  Synthesized
  Modified Amino Acids (4)..(4): Xaa4 = norLeu = Norleucine, Nle
  Modified Amino Acids (8)..(8): Xaa4 = norLeu = Norleucine, Nle
CCSXCCNXACAGCY

SEQ ID NO: 918 - protein, 14 aa, Artificial Sequence
  Synthesized
  Modified Amino Acid (4)..(4): Xaa4 = norLeu = Norleucine, Nle
CCSXCCNIACAGCY

SEQ ID NO: 919 - protein, 14 aa, Artificial Sequence
  Synthesized
  Modified Amino Acid (4)..(4): Xaa4 = norLeu = Norleucine, Nle
CCSXCCNAACAGCY

SEQ ID NO: 920 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
CCSXCCNXACAGCY

SEQ ID NO: 921 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
CCSXCCNXACAGCY

SEQ ID NO: 922 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
CCSXCCNXACAGCY

SEQ ID NO: 923 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
CCSXCCNXACAGCY

SEQ ID NO: 924 - protein, 14 aa, Artificial Sequence
  Synthesized
  Modified Amino Acid (4)..(4): Xaa4 = ChxAla = Cyclohexyl-Aalanine, Cha
CCSXCCNIACAGCY

SEQ ID NO: 925 - protein, 14 aa, Artificial Sequence
  Synthesized
  Modified Amino Acid (4)..(4): Xaa4 = ChxAla = Cyclohexyl-Aalanine, Cha
CCSXCCNAACAGCY

SEQ ID NO: 926 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
CCSXCCNXACAGCY

SEQ ID NO: 927 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
CCSXCCNXACAGCY

SEQ ID NO: 928 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
CCSXCCNXACAGCY

SEQ ID NO: 929 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
CCSXCCNXACAGCY

SEQ ID NO: 930 - protein, 14 aa, Artificial Sequence
  Synthesized
  Modified Amino Acid (4)..(4): Xaa4 = ChxIle = Cyclohexyl-Isoleucine, Chi
CCSXCCNIACAGCY

SEQ ID NO: 931 - protein, 14 aa, Artificial Sequence
  Synthesized
  Modified Amino Acid (4)..(4): Xaa4 = ChxIle = Cyclohexyl-Isoleucine, Chi
CCSXCCNAACAGCY

SEQ ID NO: 932 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCSFCCNXACAGCY

SEQ ID NO: 933 - protein, 14 aa, Artificial Sequence
  Synthesized
  Modified Amino Acid (8)..(8): Xaa8 = Thz = Thiazolidine (4-thiazolidine-2-carboxylic acid), Tzd
CCSFCCNXACAGCY

SEQ ID NO: 934 - protein, 14 aa, Artificial Sequence
  Synthesized
  Modified Amino Acid (8)..(8): Xaa8 = HyPro = Hydroxy-Proline, Hyp, Hydroxyproline
CCSFCCNXACAGCY

SEQ ID NO: 935 - protein, 14 aa, Artificial Sequence
  Synthesized
  Modified Amino Acid (8)..(8): Xaa8 = Pip = L-Pipecolic Acid
CCSFCCNXACAGCY

SEQ ID NO: 936 - protein, 14 aa, Artificial Sequence
  Synthesized
CCSFCCNIACAGCY

SEQ ID NO: 937 - protein, 14 aa, Artificial Sequence
  Synthesized
CCSFCCNAACAGCY

SEQ ID NO: 938 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCSYCCNXACAGCY

SEQ ID NO: 939 - protein, 14 aa, Artificial Sequence
  Synthesized
  Modified Amino Acid (8)..(8): Xaa8 = Thz = Thiazolidine (4-thiazolidine-2-carboxylic acid), Tzd
CCSYCCNXACAGCY

SEQ ID NO: 940 - protein, 14 aa, Artificial Sequence
  Synthesized
  Modified Amino Acid (8)..(8): Xaa8 = HyPro = Hydroxy-Proline, Hyp, Hydroxyproline
CCSYCCNXACAGCY

SEQ ID NO: 941 - protein, 14 aa, Artificial Sequence
  Synthesized
  Modified Amino Acid (8)..(8): Xaa8 = Pip = L-Pipecolic Acid
CCSYCCNXACAGCY

SEQ ID NO: 942 - protein, 14 aa, Artificial Sequence
  Synthesized
CCSYCCNIACAGCY

SEQ ID NO: 943 - protein, 14 aa, Artificial Sequence
  Synthesized
CCSYCCNAACAGCY

SEQ ID NO: 944 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
CCSXCCNXACAGCY

SEQ ID NO: 945 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
CCSXCCNXACAGCY

SEQ ID NO: 946 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
CCSXCCNXACAGCY

SEQ ID NO: 947 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
CCSXCCNXACAGCY

SEQ ID NO: 948 - protein, 14 aa, Artificial Sequence
  Synthesized
  Modified Amino Acid (4)..(4): Xaa4 = Dopa = L-Dopa, L-dihydroxyphenylalanine
CCSXCCNIACAGCY

SEQ ID NO: 949 - protein, 14 aa, Artificial Sequence
  Synthesized
  Modified Amino Acid (4)..(4): Xaa4 = Dopa = L-Dopa, L-dihydroxyphenylalanine
CCSXCCNAACAGCY

SEQ ID NO: 950 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
CCSXCCNXACAGCY

SEQ ID NO: 951 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
CCSXCCNXACAGCY

SEQ ID NO: 952 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
CCSXCCNXACAGCY

SEQ ID NO: 953 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
CCSXCCNXACAGCY

SEQ ID NO: 954 - protein, 14 aa, Artificial Sequence
  Synthesized
  Modified Amino Acid (4)..(4): Xaa4 = NMe-Leu = N-methyl-leucine, MeLeu, N-Methylleucine
CCSXCCNIACAGCY

SEQ ID NO: 955 - protein, 14 aa, Artificial Sequence
  Synthesized
  Modified Amino Acid (4)..(4): Xaa4 = NMe-Leu = N-methyl-leucine, MeLeu, N-Methylleucine
CCSXCCNAACAGCY

SEQ ID NO: 956 - protein, 14 aa, Artificial Sequence
  Synthesized
CCSTCCNPACTGCY

SEQ ID NO: 957 - protein, 14 aa, Artificial Sequence
  Synthesized
CCSTCCNPACSGCY

SEQ ID NO: 958 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCSTCCNPACXGCY

SEQ ID NO: 959 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCSTCCNPACXGCY

SEQ ID NO: 960 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCSTCCNPACXGCY

SEQ ID NO: 961 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCSTCCNPACXGCY

SEQ ID NO: 962 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCSTCCNPACXGCY

SEQ ID NO: 963 - protein, 14 aa, Artificial Sequence
  Synthesized
  Modified Amino Acid (4)..(4): Xaa4 = hLeu = Homoleucine, Hle
CCSXCCNPACTGCY

SEQ ID NO: 964 - protein, 14 aa, Artificial Sequence
  Synthesized
  Modified Amino Acid (4)..(4): Xaa4 = hLeu = Homoleucine, Hle
CCSXCCNPACSGCY

SEQ ID NO: 965 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
CCSXCCNPACXGCY

SEQ ID NO: 966 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
CCSXCCNPACXGCY

SEQ ID NO: 967 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
CCSXCCNPACXGCY

SEQ ID NO: 968 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
CCSXCCNPACXGCY

SEQ ID NO: 969 - protein, 14 aa, Artificial Sequence
  Synthesized
  Modified Amino Acids (4)..(4): Xaa4 = hLeu = Homoleucine, Hle
  Modified Amino Acids (11)..(11): Xaa4 = hLeu = Homoleucine, Hle
CCSXCCNPACXGCY

SEQ ID NO: 970 - protein, 14 aa, Artificial Sequence
  Synthesized
  Modified Amino Acid (4)..(4): Xaa4 = norLeu = Norleucine, Nle
CCSXCCNPACTGCY

SEQ ID NO: 971 - protein, 14 aa, Artificial Sequence
  Synthesized
  Modified Amino Acid (4)..(4): Xaa4 = norLeu = Norleucine, Nle
CCSXCCNPACSGCY

SEQ ID NO: 972 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
CCSXCCNPACXGCY

SEQ ID NO: 973 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
CCSXCCNPACXGCY

SEQ ID NO: 974 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
CCSXCCNPACXGCY

SEQ ID NO: 975 - protein, 14 aa, Artificial Sequence
  Synthesized
  Modified Amino Acids (4)..(4): Xaa4 = norLeu = Norleucine, Nle
  Modified Amino Acids (11)..(11): Xaa4 = norLeu = Norleucine, Nle
CCSXCCNPACXGCY

SEQ ID NO: 976 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
CCSXCCNPACXGCY

SEQ ID NO: 977 - protein, 14 aa, Artificial Sequence
  Synthesized
  Modified Amino Acid (4)..(4): Xaa4 = norLeu = Norleucine, Nle
CCSXCCNPACTGCY

SEQ ID NO: 978 - protein, 14 aa, Artificial Sequence
  Synthesized
  Modified Amino Acid (4)..(4): Xaa4 = ChxAla = Cyclohexyl-Aalanine, Cha
CCSXCCNPACSGCY

SEQ ID NO: 979 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
CCSXCCNPACXGCY

SEQ ID NO: 980 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
CCSXCCNPACXGCY

SEQ ID NO: 981 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
CCSXCCNPACXGCY

SEQ ID NO: 982 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
CCSXCCNPACXGCY

SEQ ID NO: 983 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
CCSXCCNPACXGCY

SEQ ID NO: 984 - protein, 14 aa, Artificial Sequence
  Synthesized
  Modified Amino Acid (4)..(4): Xaa4 = ChxIle = Cyclohexyl-Isoleucine, Chi
CCSXCCNPACTGCY

SEQ ID NO: 985 - protein, 14 aa, Artificial Sequence
  Synthesized
  Modified Amino Acid (4)..(4): Xaa4 = ChxIle = Cyclohexyl-Isoleucine, Chi
CCSXCCNPACSGCY

SEQ ID NO: 986 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
CCSXCCNPACXGCY

SEQ ID NO: 987 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
CCSXCCNPACXGCY

SEQ ID NO: 988 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
CCSXCCNPACXGCY

SEQ ID NO: 989 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
CCSXCCNPACXGCY

SEQ ID NO: 990 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
CCSXCCNPACXGCY

SEQ ID NO: 991 - protein, 14 aa, Artificial Sequence
  Synthesized
CCSFCCNPACTGCY

SEQ ID NO: 992 - protein, 14 aa, Artificial Sequence
  Synthesized
CCSFCCNPACSGCY

SEQ ID NO: 993 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCSFCCNPACXGCY

SEQ ID NO: 994 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCSFCCNPACXGCY

SEQ ID NO: 995 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCSFCCNPACXGCY

SEQ ID NO: 996 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCSFCCNPACXGCY

SEQ ID NO: 997 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCSFCCNPACXGCY

SEQ ID NO: 998 - protein, 14 aa, Artificial Sequence
  Synthesized
CCSYCCNPACTGCY

SEQ ID NO: 999 - protein, 14 aa, Artificial Sequence
  Synthesized
CCSYCCNPACSGCY

SEQ ID NO: 1000 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCSYCCNPACXGCY

SEQ ID NO: 1001 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCSYCCNPACXGCY

SEQ ID NO: 1002 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCSYCCNPACXGCY

SEQ ID NO: 1003 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCSYCCNPACXGCY

SEQ ID NO: 1004 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCSYCCNPACXGCY

SEQ ID NO: 1005 - protein, 14 aa, Artificial Sequence
  Synthesized
  Modified Amino Acid (4)..(4): Xaa4 = Dopa = L-Dopa, L-dihydroxyphenylalanine
CCSXCCNPACTGCY

SEQ ID NO: 1006 - protein, 14 aa, Artificial Sequence
  Synthesized
  Modified Amino Acid (4)..(4): Xaa4 = Dopa = L-Dopa, L-dihydroxyphenylalanine
CCSXCCNPACSGCY

SEQ ID NO: 1007 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
CCSXCCNPACXGCY

SEQ ID NO: 1008 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
CCSXCCNPACXGCY

SEQ ID NO: 1009 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
CCSXCCNPACXGCY

SEQ ID NO: 1010 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
CCSXCCNPACXGCY

SEQ ID NO: 1011 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
CCSXCCNPACXGCY

SEQ ID NO: 1012 - protein, 14 aa, Artificial Sequence
  Synthesized
  Modified Amino Acid (4)..(4): Xaa4 = NMe-Leu = N-methyl-leucine, MeLeu, N-Methylleucine
CCSXCCNPACTGCY

SEQ ID NO: 1013 - protein, 14 aa, Artificial Sequence
  Synthesized
  Modified Amino Acid (4)..(4): Xaa4 = NMe-Leu = N-methyl-leucine, MeLeu, N-Methylleucine
CCSXCCNPACSGCY

SEQ ID NO: 1014 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
CCSXCCNPACXGCY

SEQ ID NO: 1015 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
CCSXCCNPACXGCY

SEQ ID NO: 1016 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
CCSXCCNPACXGCY

SEQ ID NO: 1017 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
CCSXCCNPACXGCY

SEQ ID NO: 1018 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
CCSXCCNPACXGCY

SEQ ID NO: 1019 - protein, 14 aa, Artificial Sequence
  Synthesized
  Modified Amino Acid (12)..(12): Xaa12 = D-Ala = D-Alanine
CCSTCCNPACAXCY

SEQ ID NO: 1020 - protein, 14 aa, Artificial Sequence
  Synthesized
  Modified Amino Acids (4)..(4): Xaa4 = hLeu = Homoleucine, Hle
  Modified Amino Acids (12)..(12): Xaa12 = D-Ala = D-Alanine
CCSXCCNPACAXCY

SEQ ID NO: 1021 - protein, 14 aa, Artificial Sequence
  Synthesized
  Modified Amino Acids (4)..(4): Xaa4 = norLeu = Norleucine, Nle
  Modified Amino Acids (12)..(12): Xaa12 = D-Ala = D-Alanine
CCSXCCNPACAXCY

SEQ ID NO: 1022 - protein, 14 aa, Artificial Sequence
  Synthesized
  Modified Amino Acids (4)..(4): Xaa4 = ChxAla = Cyclohexyl-Aalanine, Cha
  Modified Amino Acids (12)..(12): Xaa4 = ChxAla = Cyclohexyl-Aalanine, Cha
CCSXCCNPACAXCY

SEQ ID NO: 1023 - protein, 14 aa, Artificial Sequence
  Synthesized
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCSXCCNPACAXCY

SEQ ID NO: 1024 - protein, 14 aa, Artificial Sequence
  Synthesized
  Modified Amino Acid (12)..(12): Xaa12 = D-Ala = D-Alanine
CCSFCCNPACAXCY

SEQ ID NO: 1025 - protein, 14 aa, Artificial Sequence
  Synthesized
  Modified Amino Acid (12)..(12): Xaa12 = D-Ala = D-Alanine
CCSYCCNPACAXCY

SEQ ID NO: 1026 - protein, 14 aa, Artificial Sequence
  Synthesized
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCSXCCNPACAXCY

SEQ ID NO: 1027 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCSXCCNPACAXCY

SEQ ID NO: 1028 - protein, 14 aa, Artificial Sequence
  Synthesized
CCSTCCNPACAGCI

SEQ ID NO: 1029 - protein, 14 aa, Artificial Sequence
  Synthesized
CCSTCCNPACAGCW

SEQ ID NO: 1030 - protein, 14 aa, Artificial Sequence
  Synthesized
  Modified Amino Acid (4)..(4): Xaa4 = hLeu = Homoleucine, Hle
CCSXCCNPACAGCI

SEQ ID NO: 1031 - protein, 14 aa, Artificial Sequence
  Synthesized
  Modified Amino Acid (4)..(4): Xaa4 = hLeu = Homoleucine, Hle
CCSXCCNPACAGCW

SEQ ID NO: 1032 - protein, 14 aa, Artificial Sequence
  Synthesized
  Modified Amino Acid (4)..(4): Xaa4 = norLeu = Norleucine, Nle
CCSXCCNPACAGCI

SEQ ID NO: 1033 - protein, 14 aa, Artificial Sequence
  Synthesized
  Modified Amino Acid (4)..(4): Xaa4 = norLeu = Norleucine, Nle
CCSXCCNPACAGCW

SEQ ID NO: 1034 - protein, 14 aa, Artificial Sequence
  Synthesized
  Modified Amino Acid (4)..(4): Xaa4 = ChxAla = Cyclohexyl-Aalanine, Cha
CCSXCCNPACAGCI

SEQ ID NO: 1035 - protein, 14 aa, Artificial Sequence
  Synthesized
  Modified Amino Acid (4)..(4): Xaa4 = ChxAla = Cyclohexyl-Aalanine, Cha
CCSXCCNPACAGCW

SEQ ID NO: 1036 - protein, 14 aa, Artificial Sequence
  Synthesized
  Modified Amino Acid (4)..(4): Xaa4 = ChxIle = Cyclohexyl-Isoleucine, Chi
CCSXCCNPACAGCI

SEQ ID NO: 1037 - protein, 14 aa, Artificial Sequence
  Synthesized
  Modified Amino Acid (4)..(4): Xaa4 = ChxIle = Cyclohexyl-Isoleucine, Chi
CCSXCCNPACAGCW

SEQ ID NO: 1038 - protein, 14 aa, Artificial Sequence
  Synthesized
CCSFCCNPACAGCI

SEQ ID NO: 1039 - protein, 14 aa, Artificial Sequence
  Synthesized
CCSFCCNPACAGCW

SEQ ID NO: 1040 - protein, 14 aa, Artificial Sequence
  Synthesized
CCSYCCNPACAGCI

SEQ ID NO: 1041 - protein, 14 aa, Artificial Sequence
  Synthesized
CCSYCCNPACAGCW

SEQ ID NO: 1042 - protein, 14 aa, Artificial Sequence
  Synthesized
  Modified Amino Acid (4)..(4): Xaa4 = Dopa = L-Dopa, L-dihydroxyphenylalanine
CCSXCCNPACAGCI

SEQ ID NO: 1043 - protein, 14 aa, Artificial Sequence
  Synthesized
  Modified Amino Acid (4)..(4): Xaa4 = Dopa = L-Dopa, L-dihydroxyphenylalanine
CCSXCCNPACAGCW

SEQ ID NO: 1044 - protein, 14 aa, Artificial Sequence
  Synthesized
  Modified Amino Acid (4)..(4): Xaa4 = NMe-Leu = N-methyl-leucine, MeLeu, N-Methylleucine
CCSXCCNPACAGCI

SEQ ID NO: 1045 - protein, 14 aa, Artificial Sequence
  Synthesized
  Modified Amino Acid (4)..(4): Xaa4 = NMe-Leu = N-methyl-leucine, MeLeu, N-Methylleucine
CCSXCCNPACAGCW

SEQ ID NO: 1046 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
CCXTCCNXACAGCY

SEQ ID NO: 1047 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
CCXTCCNXACAGCY

SEQ ID NO: 1048 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
CCXTCCNXACAGCY

SEQ ID NO: 1049 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
CCXTCCNXACAGCY

SEQ ID NO: 1050 - protein, 14 aa, Artificial Sequence
  Synthesized
  Modified Amino Acid (3)..(3): Xaa3 = hSer = Homoserine, Hse
CCXTCCNIACAGCY

SEQ ID NO: 1051 - protein, 14 aa, Artificial Sequence
  Synthesized
  Modified Amino Acid (3)..(3): Xaa3 = hSer = Homoserine, Hse
CCXTCCNAACAGCY

SEQ ID NO: 1052 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
CCXXCCNXACAGCY

SEQ ID NO: 1053 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
CCXXCCNXACAGCY

SEQ ID NO: 1054 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
CCXXCCNXACAGCY

SEQ ID NO: 1055 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (8)..(8): Xaa8 = Pip = L-Pipecolic Acid
CCXXCCNXACAGCY

SEQ ID NO: 1056 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
CCXXCCNIACAGCY

SEQ ID NO: 1057 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
CCXXCCNAACAGCY

SEQ ID NO: 1058 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
CCXXCCNXACAGCY

SEQ ID NO: 1059 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
CCXXCCNXACAGCY

SEQ ID NO: 1060 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
CCXXCCNXACAGCY

SEQ ID NO: 1061 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (8)..(8): Xaa8 = Pip = L-Pipecolic Acid
CCXXCCNXACAGCY

SEQ ID NO: 1062 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
CCXXCCNIACAGCY

SEQ ID NO: 1063 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
CCXXCCNAACAGCY

SEQ ID NO: 1064 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
CCXXCCNXACAGCY

SEQ ID NO: 1065 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
CCXXCCNXACAGCY

SEQ ID NO: 1066 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
CCXXCCNXACAGCY

SEQ ID NO: 1067 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
CCXXCCNXACAGCY

SEQ ID NO: 1068 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
CCXXCCNIACAGCY

SEQ ID NO: 1069 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
CCXXCCNAACAGCY

SEQ ID NO: 1070 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
CCXXCCNXACAGCY

SEQ ID NO: 1071 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
CCXXCCNXACAGCY

SEQ ID NO: 1072 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
CCXXCCNXACAGCY

SEQ ID NO: 1073 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
CCXXCCNXACAGCY

SEQ ID NO: 1074 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
CCXXCCNIACAGCY

SEQ ID NO: 1075 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
CCXXCCNAACAGCY

SEQ ID NO: 1076 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
CCXFCCNXACAGCY

SEQ ID NO: 1077 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
CCXFCCNXACAGCY

SEQ ID NO: 1078 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
CCXFCCNXACAGCY

SEQ ID NO: 1079 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
CCXFCCNXACAGCY

SEQ ID NO: 1080 - protein, 14 aa, Artificial Sequence
  Synthesized
  Modified Amino Acid (3)..(3): Xaa3 = hSer = Homoserine, Hse
CCXFCCNIACAGCY

SEQ ID NO: 1081 - protein, 14 aa, Artificial Sequence
  Synthesized
  Modified Amino Acid (3)..(3): Xaa3 = hSer = Homoserine, Hse
CCXFCCNAACAGCY

SEQ ID NO: 1082 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
CCXYCCNXACAGCY

SEQ ID NO: 1083 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
CCXYCCNXACAGCY

SEQ ID NO: 1084 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
CCXYCCNXACAGCY

SEQ ID NO: 1085 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
CCXYCCNXACAGCY

SEQ ID NO: 1086 - protein, 14 aa, Artificial Sequence
  Synthesized
  Modified Amino Acid (3)..(3): Xaa3 = hSer = Homoserine, Hse
CCXYCCNIACAGCY

SEQ ID NO: 1087 - protein, 14 aa, Artificial Sequence
  Synthesized
  Modified Amino Acid (3)..(3): Xaa3 = hSer = Homoserine, Hse
CCXYCCNAACAGCY

SEQ ID NO: 1088 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
CCXXCCNXACAGCY

SEQ ID NO: 1089 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
CCXXCCNXACAGCY

SEQ ID NO: 1090 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
CCXXCCNXACAGCY

SEQ ID NO: 1091 - protein, 14 aa, Artificial Sequence
  Synthesized
  Modified Amino Acids (3)..(4): Xaa3 = hSer = Homoserine, Hse Xaa4 = Dopa = L-Dopa, L-dihydroxyphenylalanine Xaa8 = Pip = L-Pipecolic Acid
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
CCXXCCNXACAGCY

SEQ ID NO: 1092 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
CCXXCCNIACAGCY

SEQ ID NO: 1093 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
CCXXCCNAACAGCY

SEQ ID NO: 1094 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
CCXXCCNXACAGCY

SEQ ID NO: 1095 - protein, 14 aa, Artificial Sequence
  Synthesized
  Modified Amino Acids (3)..(4): Xaa3 = hSer = Homoserine, Hse Xaa4 = NMe-Leu = N-methyl-leucine, MeLeu, N-Methylleucine Xaa8 = Thz = Thiazolidine (4-thiazolidine-2-carboxylic acid), Tzd
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
CCXXCCNXACAGCY

SEQ ID NO: 1096 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
CCXXCCNXACAGCY

SEQ ID NO: 1097 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
CCXXCCNXACAGCY

SEQ ID NO: 1098 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
CCXXCCNIACAGCY

SEQ ID NO: 1099 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
CCXXCCNAACAGCY

SEQ ID NO: 1100 - protein, 14 aa, Artificial Sequence
  Synthesized
  Modified Amino Acid (3)..(3): Xaa3 = hSer = Homoserine, Hse
CCXTCCNPACTGCY

SEQ ID NO: 1101 - protein, 14 aa, Artificial Sequence
  Synthesized
  Modified Amino Acid (3)..(3): Xaa3 = hSer = Homoserine, Hse
CCXTCCNPACSGCY

SEQ ID NO: 1102 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
CCXTCCNPACXGCY

SEQ ID NO: 1103 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
CCXTCCNPACXGCY

SEQ ID NO: 1104 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
CCXTCCNPACXGCY

SEQ ID NO: 1105 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
CCXTCCNPACXGCY

SEQ ID NO: 1106 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
CCXTCCNPACXGCY

SEQ ID NO: 1107 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
CCXXCCNPACTGCY

SEQ ID NO: 1108 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
CCXXCCNPACSGCY

SEQ ID NO: 1109 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1110 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1111 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1112 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1113 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
CCXXCCNPACXGCY

SEQ ID NO: 1114 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
CCXXCCNPACTGCY

SEQ ID NO: 1115 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
CCXXCCNPACSGCY

SEQ ID NO: 1116 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1117 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1118 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1119 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1120 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
CCXXCCNPACXGCY

SEQ ID NO: 1121 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
CCXXCCNPACTGCY

SEQ ID NO: 1122 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
CCXXCCNPACSGCY

SEQ ID NO: 1123 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1124 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1125 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1126 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1127 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
CCXXCCNPACXGCY

SEQ ID NO: 1128 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
CCXXCCNPACTGCY

SEQ ID NO: 1129 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
CCXXCCNPACSGCY

SEQ ID NO: 1130 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1131 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1132 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1133 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1134 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
CCXXCCNPACXGCY

SEQ ID NO: 1135 - protein, 14 aa, Artificial Sequence
  Synthesized
  Modified Amino Acid (3)..(3): Xaa3 = hSer = Homoserine, Hse
CCXFCCNPACTGCY

SEQ ID NO: 1136 - protein, 14 aa, Artificial Sequence
  Synthesized
  Modified Amino Acid (3)..(3): Xaa3 = hSer = Homoserine, Hse
CCXFCCNPACSGCY

SEQ ID NO: 1137 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
CCXFCCNPACXGCY

SEQ ID NO: 1138 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
CCXFCCNPACXGCY

SEQ ID NO: 1139 - protein, 14 aa, Artificial Sequence
  Synthesized
  Modified Amino Acids (3)..(11): Xaa3 = hSer = Homoserine, Hse Xaa11 = 4NO2-Phe = 4-nitro-Phenylalanine, Phe(4-NO2), 4-Nitrophenylalanine
  Modified Amino Acids (3)..(11): Xaa3 = hSer = Homoserine, Hse Xaa11 = 4NO2-Phe = 4-nitro-Phenylalanine, Phe(4-NO2), 4-Nitrophenylalanine
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
CCXFCCNPACXGCY

SEQ ID NO: 1140 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
CCXFCCNPACXGCY

SEQ ID NO: 1141 - protein, 14 aa, Artificial Sequence
  Synthesized
  Modified Amino Acids (3)..(3): Xaa3 = hSer = Homoserine, Hse
  Modified Amino Acids (3)..(3): Xaa11 = 4MeF3-Phe = Phe(4-MeF3), 4-trifluoromethylphenylalanine
  misc_feature (11)..(11): Xaa can be any naturally occurring amino acid
CCXFCCNPACXGCY

SEQ ID NO: 1142 - protein, 14 aa, Artificial Sequence
  Synthesized
  Modified Amino Acid (3)..(3): Xaa3 = hSer = Homoserine, Hse
CCXYCCNPACTGCY

SEQ ID NO: 1143 - protein, 14 aa, Artificial Sequence
  Synthesized
  Modified Amino Acid (3)..(3): Xaa3 = hSer = Homoserine, Hse
CCXYCCNPACSGCY

SEQ ID NO: 1144 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
CCXYCCNPACXGCY

SEQ ID NO: 1145 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
CCXYCCNPACXGCY

SEQ ID NO: 1146 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
CCXYCCNPACXGCY

SEQ ID NO: 1147 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
CCXYCCNPACXGCY

SEQ ID NO: 1148 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
CCXYCCNPACXGCY

SEQ ID NO: 1149 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
CCXXCCNPACTGCY

SEQ ID NO: 1150 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
CCXXCCNPACSGCY

SEQ ID NO: 1151 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1152 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1153 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1154 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1155 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
CCXXCCNPACXGCY

SEQ ID NO: 1156 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
CCXXCCNPACTGCY

SEQ ID NO: 1157 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
CCXXCCNPACSGCY

SEQ ID NO: 1158 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1159 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1160 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1161 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1162 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
CCXXCCNPACXGCY

SEQ ID NO: 1163 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXTCCNPACAXCY

SEQ ID NO: 1164 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
  Modified Amino Acids (12)..(12): Xaa12 = D-Ala = D-Alanine
CCXXCCNPACAXCY

SEQ ID NO: 1165 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
  Modified Amino Acids (12)..(12): Xaa12 = D-Ala = D-Alanine
CCXXCCNPACAXCY

SEQ ID NO: 1166 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
  Modified Amino Acids (12)..(12): Xaa12 = D-Ala = D-Alanine
CCXXCCNPACAXCY

SEQ ID NO: 1167 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCXXCCNPACAXCY

SEQ ID NO: 1168 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXFCCNPACAXCY

SEQ ID NO: 1169 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXYCCNPACAXCY

SEQ ID NO: 1170 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCXXCCNPACAXCY

SEQ ID NO: 1171 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCXXCCNPACAXCY

SEQ ID NO: 1172 - protein, 14 aa, Artificial Sequence
  Synthesized
  Modified Amino Acid (3)..(3): Xaa3 = hSer = Homoserine, Hse
CCXTCCNPACAGCI

SEQ ID NO: 1173 - protein, 14 aa, Artificial Sequence
  Synthesized
  Modified Amino Acid (3)..(3): Xaa3 = hSer = Homoserine, Hse
CCXTCCNPACAGCW

SEQ ID NO: 1174 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
CCXXCCNPACAGCI

SEQ ID NO: 1175 - protein, 14 aa, Artificial Sequence
  Synthesized
  Modified Amino Acids (3)..(3): Xaa3 = hSer = Homoserine, Hse
  Modified Amino Acids (4)..(4): Xaa4 = hLeu = Homoleucine, Hle
CCXXCCNPACAGCW

SEQ ID NO: 1176 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
CCXXCCNPACAGCI

SEQ ID NO: 1177 - protein, 14 aa, Artificial Sequence
  Synthesized
  Modified Amino Acids (3)..(3): Xaa3 = hSer = Homoserine, Hse
  Modified Amino Acids (4)..(4): Xaa4 = norLeu = Norleucine, Nle
CCXXCCNPACAGCW

SEQ ID NO: 1178 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
CCXXCCNPACAGCI

SEQ ID NO: 1179 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxAla = Cyclohexyl-Aalanine, Cha
CCXXCCNPACAGCW

SEQ ID NO: 1180 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
CCXXCCNPACAGCI

SEQ ID NO: 1181 - protein, 14 aa, Artificial Sequence
  Synthesized
  Modified Amino Acids (3)..(3): Xaa3 = hSer = Homoserine, Hse
  Modified Amino Acids (4)..(4): Xaa4 = ChxIle = Cyclohexyl-Isoleucine, Chi
CCXXCCNPACAGCW

SEQ ID NO: 1182 - protein, 14 aa, Artificial Sequence
  Synthesized
  Modified Amino Acid (3)..(3): Xaa3 = hSer = Homoserine, Hse
CCXFCCNPACAGCI

SEQ ID NO: 1183 - protein, 14 aa, Artificial Sequence
  Synthesized
  Modified Amino Acid (3)..(3): Xaa3 = hSer = Homoserine, Hse
CCXFCCNPACAGCW

SEQ ID NO: 1184 - protein, 14 aa, Artificial Sequence
  Synthesized
  Modified Amino Acid (3)..(3): Xaa3 = hSer = Homoserine, Hse
CCXYCCNPACAGCI

SEQ ID NO: 1185 - protein, 14 aa, Artificial Sequence
  Synthesized
  Modified Amino Acid (3)..(3): Xaa3 = hSer = Homoserine, Hse
CCXYCCNPACAGCW

SEQ ID NO: 1186 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
CCXXCCNPACAGCI

SEQ ID NO: 1187 - protein, 14 aa, Artificial Sequence
  Synthesized
  Modified Amino Acids (3)..(3): Xaa3 = hSer = Homoserine, Hse
  Modified Amino Acids (4)..(4): Xaa4 = Dopa = L-Dopa, L-dihydroxyphenylalanine
CCXXCCNPACAGCW

SEQ ID NO: 1188 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
CCXXCCNPACAGCI

SEQ ID NO: 1189 - protein, 14 aa, Artificial Sequence
  Synthesized
  Modified Amino Acids (3)..(3): Xaa3 = hSer = Homoserine, Hse
  Modified Amino Acids (4)..(4): Xaa4 = NMe-Leu = N-methyl-leucine, MeLeu, N-Methylleucine
CCXXCCNPACAGCW

SEQ ID NO: 1190 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
CCXTCCNXACAGCY

SEQ ID NO: 1191 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
CCXTCCNXACAGCY

SEQ ID NO: 1192 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
CCXTCCNXACAGCY

SEQ ID NO: 1193 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
CCXTCCNXACAGCY

SEQ ID NO: 1194 - protein, 14 aa, Artificial Sequence
  Synthesized
  Modified Amino Acid (3)..(3): Xaa3 = Csa = Cysteic Acid
CCXTCCNIACAGCY

SEQ ID NO: 1195 - protein, 14 aa, Artificial Sequence
  Synthesized
  Modified Amino Acid (3)..(3): Xaa3 = Csa = Cysteic Acid
CCXTCCNAACAGCY

SEQ ID NO: 1196 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (8)..(8): Xaa4 = hLeu = Homoleucine, Hle Xaa8 = Dhp = 3,4,-dihydro-Proline, D-Pro 3,4-Dehydroproline
CCXXCCNXACAGCY

SEQ ID NO: 1197 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
CCXXCCNXACAGCY

SEQ ID NO: 1198 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
CCXXCCNXACAGCY

SEQ ID NO: 1199 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (8)..(8): Xaa8 = Pip = L-Pipecolic Acid
CCXXCCNXACAGCY

SEQ ID NO: 1200 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
CCXXCCNIACAGCY

SEQ ID NO: 1201 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
CCXXCCNAACAGCY

SEQ ID NO: 1202 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
CCXXCCNXACAGCY

SEQ ID NO: 1203 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
CCXXCCNXACAGCY

SEQ ID NO: 1204 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
CCXXCCNXACAGCY

SEQ ID NO: 1205 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (8)..(8): Xaa8 = Pip = L-Pipecolic Acid
CCXXCCNXACAGCY

SEQ ID NO: 1206 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
CCXXCCNIACAGCY

SEQ ID NO: 1207 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
CCXXCCNAACAGCY

SEQ ID NO: 1208 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
CCXXCCNXACAGCY

SEQ ID NO: 1209 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
CCXXCCNXACAGCY

SEQ ID NO: 1210 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
CCXXCCNXACAGCY

SEQ ID NO: 1211 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
CCXXCCNXACAGCY

SEQ ID NO: 1212 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
CCXXCCNIACAGCY

SEQ ID NO: 1213 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
CCXXCCNAACAGCY

SEQ ID NO: 1214 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
CCXXCCNXACAGCY

SEQ ID NO: 1215 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
CCXXCCNXACAGCY

SEQ ID NO: 1216 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
CCXXCCNXACAGCY

SEQ ID NO: 1217 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
CCXXCCNXACAGCY

SEQ ID NO: 1218 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
CCXXCCNIACAGCY

SEQ ID NO: 1219 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
CCXXCCNAACAGCY

SEQ ID NO: 1220 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
CCXFCCNXACAGCY

SEQ ID NO: 1221 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
CCXFCCNXACAGCY

SEQ ID NO: 1222 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
CCXFCCNXACAGCY

SEQ ID NO: 1223 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
CCXFCCNXACAGCY

SEQ ID NO: 1224 - protein, 14 aa, Artificial Sequence
  Synthesized
  Modified Amino Acid (3)..(3): Xaa3 = Csa = Cysteic Acid
CCXFCCNIACAGCY

SEQ ID NO: 1225 - protein, 14 aa, Artificial Sequence
  Synthesized
  Modified Amino Acid (3)..(3): Xaa3 = Csa = Cysteic Acid
CCXFCCNAACAGCY

SEQ ID NO: 1226 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
CCXYCCNXACAGCY

SEQ ID NO: 1227 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
CCXYCCNXACAGCY

SEQ ID NO: 1228 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
CCXYCCNXACAGCY

SEQ ID NO: 1229 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
CCXYCCNXACAGCY

SEQ ID NO: 1230 - protein, 14 aa, Artificial Sequence
  Synthesized
  Modified Amino Acid (3)..(3): Xaa3 = Csa = Cysteic Acid
CCXYCCNIACAGCY

SEQ ID NO: 1231 - protein, 14 aa, Artificial Sequence
  Synthesized
  Modified Amino Acid (3)..(3): Xaa3 = Csa = Cysteic Acid
CCXYCCNAACAGCY

SEQ ID NO: 1232 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
CCXXCCNXACAGCY

SEQ ID NO: 1233 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
CCXXCCNXACAGCY

SEQ ID NO: 1234 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
CCXXCCNXACAGCY

SEQ ID NO: 1235 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
CCXXCCNXACAGCY

SEQ ID NO: 1236 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
CCXXCCNIACAGCY

SEQ ID NO: 1237 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
CCXXCCNAACAGCY

SEQ ID NO: 1238 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
CCXXCCNXACAGCY

SEQ ID NO: 1239 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
CCXXCCNXACAGCY

SEQ ID NO: 1240 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
CCXXCCNXACAGCY

SEQ ID NO: 1241 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
CCXXCCNXACAGCY

SEQ ID NO: 1242 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
CCXXCCNIACAGCY

SEQ ID NO: 1243 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
CCXXCCNAACAGCY

SEQ ID NO: 1244 - protein, 14 aa, Artificial Sequence
  Synthesized
  Modified Amino Acid (3)..(3): Xaa3 = Csa = Cysteic Acid
CCXTCCNPACTGCY

SEQ ID NO: 1245 - protein, 14 aa, Artificial Sequence
  Synthesized
  Modified Amino Acid (3)..(3): Xaa3 = Csa = Cysteic Acid
CCXTCCNPACSGCY

SEQ ID NO: 1246 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
CCXTCCNPACXGCY

SEQ ID NO: 1247 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
CCXTCCNPACXGCY

SEQ ID NO: 1248 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
CCXTCCNPACXGCY

SEQ ID NO: 1249 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
CCXTCCNPACXGCY

SEQ ID NO: 1250 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
CCXTCCNPACXGCY

SEQ ID NO: 1251 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
CCXXCCNPACTGCY

SEQ ID NO: 1252 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
CCXXCCNPACSGCY

SEQ ID NO: 1253 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1254 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1255 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1256 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1257 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
CCXXCCNPACXGCY

SEQ ID NO: 1258 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
CCXXCCNPACTGCY

SEQ ID NO: 1259 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
CCXXCCNPACSGCY

SEQ ID NO: 1260 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1261 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1262 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1263 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1264 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
CCXXCCNPACXGCY

SEQ ID NO: 1265 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
CCXXCCNPACTGCY

SEQ ID NO: 1266 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
CCXXCCNPACSGCY

SEQ ID NO: 1267 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1268 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1269 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1270 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1271 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
CCXXCCNPACXGCY

SEQ ID NO: 1272 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
CCXXCCNPACTGCY

SEQ ID NO: 1273 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
CCXXCCNPACSGCY

SEQ ID NO: 1274 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1275 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1276 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1277 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1278 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
CCXXCCNPACXGCY

SEQ ID NO: 1279 - protein, 14 aa, Artificial Sequence
  Synthesized
  Modified Amino Acid (3)..(3): Xaa3 = Csa = Cysteic Acid
CCXFCCNPACTGCY

SEQ ID NO: 1280 - protein, 14 aa, Artificial Sequence
  Synthesized
  Modified Amino Acid (3)..(3): Xaa3 = Csa = Cysteic Acid
CCXFCCNPACSGCY

SEQ ID NO: 1281 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
CCXFCCNPACXGCY

SEQ ID NO: 1282 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
CCXFCCNPACXGCY

SEQ ID NO: 1283 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
CCXFCCNPACXGCY

SEQ ID NO: 1284 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
CCXFCCNPACXGCY

SEQ ID NO: 1285 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
CCXFCCNPACXGCY

SEQ ID NO: 1286 - protein, 14 aa, Artificial Sequence
  Synthesized
  Modified Amino Acid (3)..(3): Xaa3 = Csa = Cysteic Acid
CCXYCCNPACTGCY

SEQ ID NO: 1287 - protein, 14 aa, Artificial Sequence
  Synthesized
  Modified Amino Acid (3)..(3): Xaa3 = Csa = Cysteic Acid
CCXYCCNPACSGCY

SEQ ID NO: 1288 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
CCXYCCNPACXGCY

SEQ ID NO: 1289 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
CCXYCCNPACXGCY

SEQ ID NO: 1290 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
CCXYCCNPACXGCY

SEQ ID NO: 1291 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
CCXYCCNPACXGCY

SEQ ID NO: 1292 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
CCXYCCNPACXGCY

SEQ ID NO: 1293 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
CCXXCCNPACTGCY

SEQ ID NO: 1294 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
CCXXCCNPACSGCY

SEQ ID NO: 1295 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1296 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1297 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1298 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1299 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
CCXXCCNPACXGCY

SEQ ID NO: 1300 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
CCXXCCNPACTGCY

SEQ ID NO: 1301 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
CCXXCCNPACSGCY

SEQ ID NO: 1302 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
CCXXCCNPACXGCY

SEQ ID NO: 1303 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
CCXXCCNPACXGCY

SEQ ID NO: 1304 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
CCXXCCNPACXGCY

SEQ ID NO: 1305 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
CCXXCCNPACXGCY

SEQ ID NO: 1306 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
CCXXCCNPACXGCY

SEQ ID NO: 1307 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXTCCNPACAXCY

SEQ ID NO: 1308 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
  Modified Amino Acids (12)..(12): Xaa12 = D-Ala = D-Alanine
CCXXCCNPACAXCY

SEQ ID NO: 1309 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
  Modified Amino Acids (12)..(12): Xaa12 = D-Ala = D-Alanine
CCXXCCNPACAXCY

SEQ ID NO: 1310 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
  Modified Amino Acids (12)..(12): Xaa12 = D-Ala = D-Alanine
CCXXCCNPACAXCY

SEQ ID NO: 1311 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCXXCCNPACAXCY

SEQ ID NO: 1312 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXFCCNPACAXCY

SEQ ID NO: 1313 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXYCCNPACAXCY

SEQ ID NO: 1314 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCXXCCNPACAXCY

SEQ ID NO: 1315 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCXXCCNPACAXCY

SEQ ID NO: 1316 - protein, 14 aa, Artificial Sequence
  Synthesized
  Modified Amino Acid (3)..(3): Xaa3 = Csa = Cysteic Acid
CCXTCCNPACAGCI

SEQ ID NO: 1317 - protein, 14 aa, Artificial Sequence
  Synthesized
  Modified Amino Acid (3)..(3): Xaa3 = Csa = Cysteic Acid
CCXTCCNPACAGCW

SEQ ID NO: 1318 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
CCXXCCNPACAGCI

SEQ ID NO: 1319 - protein, 14 aa, Artificial Sequence
  Synthesized
  Modified Amino Acids (3)..(3): Xaa3 = Csa = Cysteic Acid
  Modified Amino Acids (4)..(4): Xaa4 = hLeu = Homoleucine, Hle
CCXXCCNPACAGCW

SEQ ID NO: 1320 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
CCXXCCNPACAGCI

SEQ ID NO: 1321 - protein, 14 aa, Artificial Sequence
  Synthesized
  Modified Amino Acids (3)..(3): Xaa3 = Csa = Cysteic Acid
  Modified Amino Acids (4)..(4): Xaa4 = norLeu = Norleucine, Nle
CCXXCCNPACAGCW

SEQ ID NO: 1322 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
CCXXCCNPACAGCI

SEQ ID NO: 1323 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxAla = Cyclohexyl-Aalanine, Cha
CCXXCCNPACAGCW

SEQ ID NO: 1324 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
CCXXCCNPACAGCI

SEQ ID NO: 1325 - protein, 14 aa, Artificial Sequence
  Synthesized
  Modified Amino Acids (3)..(3): Xaa3 = Csa = Cysteic Acid
  Modified Amino Acids (4)..(4): Xaa4 = ChxIle = Cyclohexyl-Isoleucine, Chi
CCXXCCNPACAGCW

SEQ ID NO: 1326 - protein, 14 aa, Artificial Sequence
  Synthesized
  Modified Amino Acid (3)..(3): Xaa3 = Csa = Cysteic Acid
CCXFCCNPACAGCI

SEQ ID NO: 1327 - protein, 14 aa, Artificial Sequence
  Synthesized
  Modified Amino Acid (3)..(3): Xaa3 = Csa = Cysteic Acid
CCXFCCNPACAGCW

SEQ ID NO: 1328 - protein, 14 aa, Artificial Sequence
  Synthesized
  Modified Amino Acid (3)..(3): Xaa3 = Csa = Cysteic Acid
CCXYCCNPACAGCI

SEQ ID NO: 1329 - protein, 14 aa, Artificial Sequence
  Synthesized
  Modified Amino Acid (3)..(3): Xaa3 = Csa = Cysteic Acid
CCXYCCNPACAGCW

SEQ ID NO: 1330 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
CCXXCCNPACAGCI

SEQ ID NO: 1331 - protein, 14 aa, Artificial Sequence
  Synthesized
  Modified Amino Acids (3)..(3): Xaa3 = Csa = Cysteic Acid
  Modified Amino Acids (4)..(4): Xaa4 = Dopa = L-Dopa, L-dihydroxyphenylalanine
CCXXCCNPACAGCW

SEQ ID NO: 1332 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
CCXXCCNPACAGCI

SEQ ID NO: 1333 - protein, 14 aa, Artificial Sequence
  Synthesized
  Modified Amino Acids (3)..(3): Xaa3 = Csa = Cysteic Acid
  Modified Amino Acids (4)..(4): Xaa4 = NMe-Leu = N-methyl-leucine, MeLeu, N-Methylleucine
CCXXCCNPACAGCW

SEQ ID NO: 1334 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCSLCCNXACTGCY

SEQ ID NO: 1335 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCSLCCNXACSGCY

SEQ ID NO: 1336 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCSLCCNXACXGCY

SEQ ID NO: 1337 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanineline
CCSLCCNXACXGCY

SEQ ID NO: 1338 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCSLCCNXACXGCY

SEQ ID NO: 1339 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCSLCCNXACXGCY

SEQ ID NO: 1340 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCSLCCNXACXGCY

SEQ ID NO: 1341 - protein, 14 aa, Artificial Sequence
  Synthesized
  Modified Amino Acid (8)..(8): Xaa8 = Thz = Thiazolidine (4-thiazolidine-2-carboxylic acid), Tzd
CCSLCCNXACTGCY

SEQ ID NO: 1342 - protein, 14 aa, Artificial Sequence
  Synthesized
  Modified Amino Acid (8)..(8): Xaa8 = Thz = Thiazolidine (4-thiazolidine-2-carboxylic acid), Tzd
CCSLCCNXACSGCY

SEQ ID NO: 1343 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCSLCCNXACXGCY

SEQ ID NO: 1344 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCSLCCNXACXGCY

SEQ ID NO: 1345 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCSLCCNXACXGCY

SEQ ID NO: 1346 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCSLCCNXACXGCY

SEQ ID NO: 1347 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCSLCCNXACXGCY

SEQ ID NO: 1348 - protein, 14 aa, Artificial Sequence
  Synthesized
  Modified Amino Acid (8)..(8): Xaa8 = HyPro = Hydroxy-Proline, Hyp, Hydroxyproline
CCSLCCNXACTGCY

SEQ ID NO: 1349 - protein, 14 aa, Artificial Sequence
  Synthesized
  Modified Amino Acid (8)..(8): Xaa8 = HyPro = Hydroxy-Proline, Hyp, Hydroxyproline
CCSLCCNXACSGCY

SEQ ID NO: 1350 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCSLCCNXACXGCY

SEQ ID NO: 1351 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCSLCCNXACXGCY

SEQ ID NO: 1352 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCSLCCNXACXGCY

SEQ ID NO: 1353 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCSLCCNXACXGCY

SEQ ID NO: 1354 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCSLCCNXACXGCY

SEQ ID NO: 1355 - protein, 14 aa, Artificial Sequence
  Synthesized
  Modified Amino Acid (8)..(8): Xaa8 = Pip = L-Pipecolic Acid
CCSLCCNXACTGCY

SEQ ID NO: 1356 - protein, 14 aa, Artificial Sequence
  Synthesized
  Modified Amino Acid (8)..(8): Xaa8 = Pip = L-Pipecolic Acid
CCSLCCNXACSGCY

SEQ ID NO: 1357 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCSLCCNXACXGCY

SEQ ID NO: 1358 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCSLCCNXACXGCY

SEQ ID NO: 1359 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCSLCCNXACXGCY

SEQ ID NO: 1360 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCSLCCNXACXGCY

SEQ ID NO: 1361 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCSLCCNXACXGCY

SEQ ID NO: 1362 - protein, 14 aa, Artificial Sequence
  Synthesized
CCSLCCNIACTGCY

SEQ ID NO: 1363 - protein, 14 aa, Artificial Sequence
  Synthesized
CCSLCCNIACSGCY

SEQ ID NO: 1364 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCSLCCNIACXGCY

SEQ ID NO: 1365 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCSLCCNIACXGCY

SEQ ID NO: 1366 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCSLCCNIACXGCY

SEQ ID NO: 1367 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCSLCCNIACXGCY

SEQ ID NO: 1368 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCSLCCNIACXGCY

SEQ ID NO: 1369 - protein, 14 aa, Artificial Sequence
  Synthesized
CCSLCCNAACTGCY

SEQ ID NO: 1370 - protein, 14 aa, Artificial Sequence
  Synthesized
CCSLCCNAACSGCY

SEQ ID NO: 1371 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCSLCCNAACXGCY

SEQ ID NO: 1372 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCSLCCNAACXGCY

SEQ ID NO: 1373 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCSLCCNAACXGCY

SEQ ID NO: 1374 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCSLCCNAACXGCY

SEQ ID NO: 1375 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCSLCCNAACXGCY

SEQ ID NO: 1376 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCSLCCNXACAXCY

SEQ ID NO: 1377 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCSLCCNXACAXCY

SEQ ID NO: 1378 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCSLCCNXACAXCY

SEQ ID NO: 1379 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCSLCCNXACAXCY

SEQ ID NO: 1380 - protein, 14 aa, Artificial Sequence
  Synthesized
  Modified Amino Acid (12)..(12): Xaa12 = D-Ala = D-Alanine
CCSLCCNIACAXCY

SEQ ID NO: 1381 - protein, 14 aa, Artificial Sequence
  Synthesized
  Modified Amino Acid (12)..(12): Xaa12 = D-Ala = D-Alanine
CCSLCCNAACAXCY

SEQ ID NO: 1382 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCSLCCNXACAGCI

SEQ ID NO: 1383 - protein, 14 aa, Artificial Sequence
  Synthesized
  Modified Amino Acid (8)..(8): Xaa8 = Thz = Thiazolidine (4-thiazolidine-2-carboxylic acid), Tzd
CCSLCCNXACAGCI

SEQ ID NO: 1384 - protein, 14 aa, Artificial Sequence
  Synthesized
  Modified Amino Acid (8)..(8): Xaa8 = HyPro = Hydroxy-Proline, Hyp, Hydroxyproline
CCSLCCNXACAGCI

SEQ ID NO: 1385 - protein, 14 aa, Artificial Sequence
  Synthesized
  Modified Amino Acid (8)..(8): Xaa8 = Pip = L-Pipecolic Acid
CCSLCCNXACAGCI

SEQ ID NO: 1386 - protein, 14 aa, Artificial Sequence
  Synthesized
CCSLCCNIACAGCI

SEQ ID NO: 1387 - protein, 14 aa, Artificial Sequence
  Synthesized
CCSLCCNAACAGCI

SEQ ID NO: 1388 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCSLCCNXACAGCW

SEQ ID NO: 1389 - protein, 14 aa, Artificial Sequence
  Synthesized
  Modified Amino Acid (8)..(8): Xaa8 = Thz = Thiazolidine (4-thiazolidine-2-carboxylic acid), Tzd
CCSLCCNXACAGCW

SEQ ID NO: 1390 - protein, 14 aa, Artificial Sequence
  Synthesized
  Modified Amino Acid (8)..(8): Xaa8 = HyPro = Hydroxy-Proline, Hyp, Hydroxyproline
CCSLCCNXACAGCW

SEQ ID NO: 1391 - protein, 14 aa, Artificial Sequence
  Synthesized
  Modified Amino Acid (8)..(8): Xaa8 = Pip = L-Pipecolic Acid
CCSLCCNXACAGCW

SEQ ID NO: 1392 - protein, 14 aa, Artificial Sequence
  Synthesized
CCSLCCNIACAGCW

SEQ ID NO: 1393 - protein, 14 aa, Artificial Sequence
  Synthesized
CCSLCCNAACAGCW

SEQ ID NO: 1394 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
CCXLCCNXACTGCY

SEQ ID NO: 1395 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
CCXLCCNXACSGCY

SEQ ID NO: 1396 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCXLCCNXACXGCY

SEQ ID NO: 1397 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCXLCCNXACXGCY

SEQ ID NO: 1398 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
  Modified Amino Acids (11)..(11): Xaa8 = Dhp = 3,4,-dihydro-Proline, D-Pro 3,4-Dehydroproline Xaa11 = 4NO2-Phe = 4-nitro-Phenylalanine, Phe(4-NO2), 4-Nitrophenylalanine
CCXLCCNXACXGCY

SEQ ID NO: 1399 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCXLCCNXACXGCY

SEQ ID NO: 1400 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCXLCCNXACXGCY

SEQ ID NO: 1401 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
CCXLCCNXACTGCY

SEQ ID NO: 1402 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
CCXLCCNXACSGCY

SEQ ID NO: 1403 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCXLCCNXACXGCY

SEQ ID NO: 1404 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCXLCCNXACXGCY

SEQ ID NO: 1405 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCXLCCNXACXGCY

SEQ ID NO: 1406 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
  Modified Amino Acids (11)..(11): Xaa8 = Thz = Thiazolidine (4-thiazolidine-2-carboxylic acid), Tzd Xaa11 = 5F-Phe = Pentafluoro-Phenylalanine, Phe(3-F), 3-fluorophenylalanine
CCXLCCNXACXGCY

SEQ ID NO: 1407 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCXLCCNXACXGCY

SEQ ID NO: 1408 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
CCXLCCNXACTGCY

SEQ ID NO: 1409 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
CCXLCCNXACSGCY

SEQ ID NO: 1410 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCXLCCNXACXGCY

SEQ ID NO: 1411 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCXLCCNXACXGCY

SEQ ID NO: 1412 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCXLCCNXACXGCY

SEQ ID NO: 1413 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCXLCCNXACXGCY

SEQ ID NO: 1414 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCXLCCNXACXGCY

SEQ ID NO: 1415 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
CCXLCCNXACTGCY

SEQ ID NO: 1416 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
CCXLCCNXACSGCY

SEQ ID NO: 1417 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCXLCCNXACXGCY

SEQ ID NO: 1418 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCXLCCNXACXGCY

SEQ ID NO: 1419 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCXLCCNXACXGCY

SEQ ID NO: 1420 - protein, 14 aa, Artificial Sequence
  Synthesized
  Modified Amino Acids (3)..(3): Xaa3 = hSer = Homoserine, Hse
  8Modified Amino Acids (8)..(8): Xaa8 = Pip = L-Pipecolic Acid
  8Modified Amino Acids (11)..(11): Xaa11 = 5F-Phe = Pentafluoro-Phenylalanine, Phe(3-F), 3-fluorophenylalanine
CCXLCCNXACXGCY

SEQ ID NO: 1421 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCXLCCNXACXGCY

SEQ ID NO: 1422 - protein, 14 aa, Artificial Sequence
  Synthesized
  Modified Amino Acid (3)..(3): Xaa3 = hSer = Homoserine, Hse
CCXLCCNIACTGCY

SEQ ID NO: 1423 - protein, 14 aa, Artificial Sequence
  Synthesized
  Modified Amino Acid (3)..(3): Xaa3 = hSer = Homoserine, Hse
CCXLCCNIACSGCY

SEQ ID NO: 1424 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
CCXLCCNIACXGCY

SEQ ID NO: 1425 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
CCXLCCNIACXGCY

SEQ ID NO: 1426 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
CCXLCCNIACXGCY

SEQ ID NO: 1427 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
CCXLCCNIACXGCY

SEQ ID NO: 1428 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
CCXLCCNIACXGCY

SEQ ID NO: 1429 - protein, 14 aa, Artificial Sequence
  Synthesized
  Modified Amino Acid (3)..(3): Xaa3 = hSer = Homoserine, Hse
CCXLCCNAACTGCY

SEQ ID NO: 1430 - protein, 14 aa, Artificial Sequence
  Synthesized
  Modified Amino Acid (3)..(3): Xaa3 = hSer = Homoserine, Hse
CCXLCCNAACSGCY

SEQ ID NO: 1431 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
CCXLCCNAACXGCY

SEQ ID NO: 1432 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
CCXLCCNAACXGCY

SEQ ID NO: 1433 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
CCXLCCNAACXGCY

SEQ ID NO: 1434 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
CCXLCCNAACXGCY

SEQ ID NO: 1435 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
CCXLCCNAACXGCY

SEQ ID NO: 1436 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline Xaa12 = D-Ala = D-Alanine
  Modified Amino Acids (12)..(12): Xaa12 = D-Ala = D-Alanine
CCXLCCNXACAXCY

SEQ ID NO: 1437 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCXLCCNXACAXCY

SEQ ID NO: 1438 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCXLCCNXACAXCY

SEQ ID NO: 1439 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
  Modified Amino Acids (12)..(12): Xaa12 = D-Ala = D-Alanine
CCXLCCNXACAXCY

SEQ ID NO: 1440 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXLCCNIACAXCY

SEQ ID NO: 1441 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXLCCNAACAXCY

SEQ ID NO: 1442 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
CCXLCCNXACAGCI

SEQ ID NO: 1443 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
CCXLCCNXACAGCI

SEQ ID NO: 1444 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
CCXLCCNXACAGCI

SEQ ID NO: 1445 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
CCXLCCNXACAGCI

SEQ ID NO: 1446 - protein, 14 aa, Artificial Sequence
  Synthesized
  Modified Amino Acid (3)..(3): Xaa3 = hSer = Homoserine, Hse
CCXLCCNIACAGCI

SEQ ID NO: 1447 - protein, 14 aa, Artificial Sequence
  Synthesized
  Modified Amino Acid (3)..(3): Xaa3 = hSer = Homoserine, Hse
CCXLCCNAACAGCI

SEQ ID NO: 1448 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Dhp = 3,4,-dihydro-Proline, D-Pro 3,4-Dehydroproline
CCXLCCNXACAGCW

SEQ ID NO: 1449 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Thz = Thiazolidine (4-thiazolidine-2-carboxylic acid), Tzd
CCXLCCNXACAGCW

SEQ ID NO: 1450 - protein, 14 aa, Artificial Sequence
  Synthesized
  Modified Amino Acids (3)..(3): Xaa3 = hSer = Homoserine, Hse
  Modified Amino Acids (8)..(8): Xaa8 = HyPro = Hydroxy-Proline, Hyp, Hydroxyproline
CCXLCCNXACAGCW

SEQ ID NO: 1451 - protein, 14 aa, Artificial Sequence
  Synthesized
  Modified Amino Acids (3)..(3): Xaa3 = hSer = Homoserine, Hse
  Modified Amino Acids (8)..(8): Xaa8 = Pip = L-Pipecolic Acid
CCXLCCNXACAGCW

SEQ ID NO: 1452 - protein, 14 aa, Artificial Sequence
  Synthesized
  Modified Amino Acid (3)..(3): Xaa3 = hSer = Homoserine, Hse
CCXLCCNIACAGCW

SEQ ID NO: 1453 - protein, 14 aa, Artificial Sequence
  Synthesized
  Modified Amino Acid (3)..(3): Xaa3 = hSer = Homoserine, Hse
CCXLCCNAACAGCW

SEQ ID NO: 1454 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
CCXLCCNXACTGCY

SEQ ID NO: 1455 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
CCXLCCNXACSGCY

SEQ ID NO: 1456 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCXLCCNXACXGCY

SEQ ID NO: 1457 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCXLCCNXACXGCY

SEQ ID NO: 1458 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCXLCCNXACXGCY

SEQ ID NO: 1459 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCXLCCNXACXGCY

SEQ ID NO: 1460 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCXLCCNXACXGCY

SEQ ID NO: 1461 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
CCXLCCNXACTGCY

SEQ ID NO: 1462 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
CCXLCCNXACSGCY

SEQ ID NO: 1463 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCXLCCNXACXGCY

SEQ ID NO: 1464 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCXLCCNXACXGCY

SEQ ID NO: 1465 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCXLCCNXACXGCY

SEQ ID NO: 1466 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCXLCCNXACXGCY

SEQ ID NO: 1467 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCXLCCNXACXGCY

SEQ ID NO: 1468 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
CCXLCCNXACTGCY

SEQ ID NO: 1469 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
CCXLCCNXACSGCY

SEQ ID NO: 1470 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCXLCCNXACXGCY

SEQ ID NO: 1471 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCXLCCNXACXGCY

SEQ ID NO: 1472 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCXLCCNXACXGCY

SEQ ID NO: 1473 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCXLCCNXACXGCY

SEQ ID NO: 1474 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCXLCCNXACXGCY

SEQ ID NO: 1475 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
CCXLCCNXACTGCY

SEQ ID NO: 1476 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
CCXLCCNXACSGCY

SEQ ID NO: 1477 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCXLCCNXACXGCY

SEQ ID NO: 1478 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCXLCCNXACXGCY

SEQ ID NO: 1479 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCXLCCNXACXGCY

SEQ ID NO: 1480 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCXLCCNXACXGCY

SEQ ID NO: 1481 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCXLCCNXACXGCY

SEQ ID NO: 1482 - protein, 14 aa, Artificial Sequence
  Synthesized
  Modified Amino Acid (3)..(3): Xaa3 = Csa = Cysteic Acid
CCXLCCNIACTGCY

SEQ ID NO: 1483 - protein, 14 aa, Artificial Sequence
  Synthesized
  Modified Amino Acid (3)..(3): Xaa3 = Csa = Cysteic Acid
CCXLCCNIACSGCY

SEQ ID NO: 1484 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
CCXLCCNIACXGCY

SEQ ID NO: 1485 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
CCXLCCNIACXGCY

SEQ ID NO: 1486 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
CCXLCCNIACXGCY

SEQ ID NO: 1487 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
CCXLCCNIACXGCY

SEQ ID NO: 1488 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
CCXLCCNIACXGCY

SEQ ID NO: 1489 - protein, 14 aa, Artificial Sequence
  Synthesized
  Modified Amino Acid (3)..(3): Xaa3 = Csa = Cysteic Acid
CCXLCCNAACTGCY

SEQ ID NO: 1490 - protein, 14 aa, Artificial Sequence
  Synthesized
  Modified Amino Acid (3)..(3): Xaa3 = Csa = Cysteic Acid
CCXLCCNAACSGCY

SEQ ID NO: 1491 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
CCXLCCNAACXGCY

SEQ ID NO: 1492 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
CCXLCCNAACXGCY

SEQ ID NO: 1493 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
CCXLCCNAACXGCY

SEQ ID NO: 1494 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
CCXLCCNAACXGCY

SEQ ID NO: 1495 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
CCXLCCNAACXGCY

SEQ ID NO: 1496 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCXLCCNXACAXCY

SEQ ID NO: 1497 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCXLCCNXACAXCY

SEQ ID NO: 1498 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCXLCCNXACAXCY

SEQ ID NO: 1499 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid Xaa12 = D-Ala = D-Alanine
  misc_feature (12)..(12): Xaa can be any naturally occurring amino acid
CCXLCCNXACAXCY

SEQ ID NO: 1500 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXLCCNIACAXCY

SEQ ID NO: 1501 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXLCCNAACAXCY

SEQ ID NO: 1502 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
CCXLCCNXACAGCI

SEQ ID NO: 1503 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
CCXLCCNXACAGCI

SEQ ID NO: 1504 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
CCXLCCNXACAGCI

SEQ ID NO: 1505 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
CCXLCCNXACAGCI

SEQ ID NO: 1506 - protein, 14 aa, Artificial Sequence
  Synthesized
  Modified Amino Acid (3)..(3): Xaa3 = Csa = Cysteic Acid
CCXLCCNIACAGCI

SEQ ID NO: 1507 - protein, 14 aa, Artificial Sequence
  Synthesized
  Modified Amino Acid (3)..(3): Xaa3 = Csa = Cysteic Acid
CCXLCCNAACAGCI

SEQ ID NO: 1508 - protein, 14 aa, Artificial Sequence
  Synthesized
  Modified Amino Acids (3)..(3): Xaa3 = Csa = Cysteic Acid
  Modified Amino Acids (8)..(8): Xaa8 = Dhp = 3,4,-dihydro-Proline, D-Pro 3,4-Dehydroproline
CCXLCCNXACAGCW

SEQ ID NO: 1509 - protein, 14 aa, Artificial Sequence
  Synthesized
  Modified Amino Acids (3)..(3): Xaa3 = Csa = Cysteic Acid
  Modified Amino Acids (8)..(8): Xaa8 = Thz = Thiazolidine (4-thiazolidine-2-carboxylic acid), Tzd
CCXLCCNXACAGCW

SEQ ID NO: 1510 - protein, 14 aa, Artificial Sequence
  Synthesized
  Modified Amino Acids (3)..(3): Xaa3 = Csa = Cysteic Acid
  Modified Amino Acids (8)..(8): Xaa8 = HyPro = Hydroxy-Proline, Hyp, Hydroxyproline
CCXLCCNXACAGCW

SEQ ID NO: 1511 - protein, 14 aa, Artificial Sequence
  Synthesized
  Modified Amino Acids (3)..(3): Xaa3 = Csa = Cysteic Acid
  Modified Amino Acids (8)..(8): Xaa8 = Pip = L-Pipecolic Acid
CCXLCCNXACAGCW

SEQ ID NO: 1512 - protein, 14 aa, Artificial Sequence
  Synthesized
  Modified Amino Acid (3)..(3): Xaa3 = Csa = Cysteic Acid
CCXLCCNIACAGCW

SEQ ID NO: 1513 - protein, 14 aa, Artificial Sequence
  Synthesized
  Modified Amino Acid (3)..(3): Xaa3 = Csa = Cysteic Acid
CCXLCCNAACAGCW

SEQ ID NO: 1514 - protein, 14 aa, Artificial Sequence
  Synthesized
  Modified Amino Acid (12)..(12): Xaa12 = D-Ala = D-Alanine
CCSLCCNPACTXCY

SEQ ID NO: 1515 - protein, 14 aa, Artificial Sequence
  Synthesized
  Modified Amino Acid (12)..(12): Xaa12 = D-Ala = D-Alanine
CCSLCCNPACSXCY

SEQ ID NO: 1516 - protein, 14 aa, Artificial Sequence
  Synthesized
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCSLCCNPACXXCY

SEQ ID NO: 1517 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCSLCCNPACXXCY

SEQ ID NO: 1518 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCSLCCNPACXXCY

SEQ ID NO: 1519 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCSLCCNPACXXCY

SEQ ID NO: 1520 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCSLCCNPACXXCY

SEQ ID NO: 1521 - protein, 14 aa, Artificial Sequence
  Synthesized
CCSLCCNPACTGCI

SEQ ID NO: 1522 - protein, 14 aa, Artificial Sequence
  Synthesized
CCSLCCNPACSGCI

SEQ ID NO: 1523 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCSLCCNPACXGCI

SEQ ID NO: 1524 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCSLCCNPACXGCI

SEQ ID NO: 1525 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCSLCCNPACXGCI

SEQ ID NO: 1526 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCSLCCNPACXGCI

SEQ ID NO: 1527 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCSLCCNPACXGCI

SEQ ID NO: 1528 - protein, 14 aa, Artificial Sequence
  Synthesized
CCSLCCNPACTGCW

SEQ ID NO: 1529 - protein, 14 aa, Artificial Sequence
  Synthesized
CCSLCCNPACSGCW

SEQ ID NO: 1530 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCSLCCNPACXGCW

SEQ ID NO: 1531 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCSLCCNPACXGCW

SEQ ID NO: 1532 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCSLCCNPACXGCW

SEQ ID NO: 1533 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCSLCCNPACXGCW

SEQ ID NO: 1534 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCSLCCNPACXGCW

SEQ ID NO: 1535 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXLCCNPACTXCY

SEQ ID NO: 1536 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXLCCNPACSXCY

SEQ ID NO: 1537 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa11 = 4F-Phe = 4-fluoro-Phenylalanine, Phe(4-F), 4-fluorophenylalanine Xaa12 = D-Ala = D-Alanine
CCXLCCNPACXXCY

SEQ ID NO: 1538 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCXLCCNPACXXCY

SEQ ID NO: 1539 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCXLCCNPACXXCY

SEQ ID NO: 1540 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCXLCCNPACXXCY

SEQ ID NO: 1541 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
  Modified Amino Acids (12)..(12): Xaa11 = 4MeF3-Phe = Phe(4-MeF3), 4-trifluoromethylphenylalanine
CCXLCCNPACXXCY

SEQ ID NO: 1542 - protein, 14 aa, Artificial Sequence
  Synthesized
  Modified Amino Acid (3)..(3): Xaa3 = hSer = Homoserine, Hse
CCXLCCNPACTGCI

SEQ ID NO: 1543 - protein, 14 aa, Artificial Sequence
  Synthesized
  Modified Amino Acid (3)..(3): Xaa3 = hSer = Homoserine, Hse
CCXLCCNPACSGCI

SEQ ID NO: 1544 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
CCXLCCNPACXGCI

SEQ ID NO: 1545 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
CCXLCCNPACXGCI

SEQ ID NO: 1546 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
CCXLCCNPACXGCI

SEQ ID NO: 1547 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
CCXLCCNPACXGCI

SEQ ID NO: 1548 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
CCXLCCNPACXGCI

SEQ ID NO: 1549 - protein, 14 aa, Artificial Sequence
  Synthesized
  Modified Amino Acid (3)..(3): Xaa3 = hSer = Homoserine, Hse
CCXLCCNPACTGCW

SEQ ID NO: 1550 - protein, 14 aa, Artificial Sequence
  Synthesized
  Modified Amino Acid (3)..(3): Xaa3 = hSer = Homoserine, Hse
CCXLCCNPACSGCW

SEQ ID NO: 1551 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4F-Phe = 4-fluoro-Phenylalanine, Phe(4-F), 4-fluorophenylalanine
CCXLCCNPACXGCW

SEQ ID NO: 1552 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeO-Phe = 4-methoxy-Phenylalanine, Phe(4-OMe), 4-methoxyphenylalanine
CCXLCCNPACXGCW

SEQ ID NO: 1553 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4NO2-Phe = 4-nitro-Phenylalanine, Phe(4-NO2), 4-Nitrophenylalanine
CCXLCCNPACXGCW

SEQ ID NO: 1554 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 5F-Phe = Pentafluoro-Phenylalanine, Phe(3-F), 3-fluorophenylalanine
CCXLCCNPACXGCW

SEQ ID NO: 1555 - protein, 14 aa, Artificial Sequence
  Synthesized
  Modified Amino Acids (3)..(3): Xaa3 = hSer = Homoserine, Hse
  Modified Amino Acids (11)..(11): Xaa11 = 4MeF3-Phe = Phe(4-MeF3), 4-trifluoromethylphenylalanine
CCXLCCNPACXGCW

SEQ ID NO: 1556 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXLCCNPACTXCY

SEQ ID NO: 1557 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXLCCNPACSXCY

SEQ ID NO: 1558 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCXLCCNPACXXCY

SEQ ID NO: 1559 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCXLCCNPACXXCY

SEQ ID NO: 1560 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCXLCCNPACXXCY

SEQ ID NO: 1561 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCXLCCNPACXXCY

SEQ ID NO: 1562 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCXLCCNPACXXCY

SEQ ID NO: 1563 - protein, 14 aa, Artificial Sequence
  Synthesized
  Modified Amino Acid (3)..(3): Xaa3 = Csa = Cysteic Acid
CCXLCCNPACTGCI

SEQ ID NO: 1564 - protein, 14 aa, Artificial Sequence
  Synthesized
  Modified Amino Acid (3)..(3): Xaa3 = Csa = Cysteic Acid
CCXLCCNPACSGCI

SEQ ID NO: 1565 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
CCXLCCNPACXGCI

SEQ ID NO: 1566 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
CCXLCCNPACXGCI

SEQ ID NO: 1567 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
CCXLCCNPACXGCI

SEQ ID NO: 1568 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
CCXLCCNPACXGCI

SEQ ID NO: 1569 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
CCXLCCNPACXGCI

SEQ ID NO: 1570 - protein, 14 aa, Artificial Sequence
  Synthesized
  Modified Amino Acid (3)..(3): Xaa3 = Csa = Cysteic Acid
CCXLCCNPACTGCW

SEQ ID NO: 1571 - protein, 14 aa, Artificial Sequence
  Synthesized
  Modified Amino Acid (3)..(3): Xaa3 = Csa = Cysteic Acid
CCXLCCNPACSGCW

SEQ ID NO: 1572 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4F-Phe = 4-fluoro-Phenylalanine, Phe(4-F), 4-fluorophenylalanine
CCXLCCNPACXGCW

SEQ ID NO: 1573 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeO-Phe = 4-methoxy-Phenylalanine, Phe(4-OMe), 4-methoxyphenylalanine
CCXLCCNPACXGCW

SEQ ID NO: 1574 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4NO2-Phe = 4-nitro-Phenylalanine, Phe(4-NO2), 4-Nitrophenylalanine
CCXLCCNPACXGCW

SEQ ID NO: 1575 - protein, 14 aa, Artificial Sequence
  Synthesized
  Modified Amino Acids (3)..(3): Xaa3 = Csa = Cysteic Acid
  Modified Amino Acids (11)..(11): Xaa11 = 5F-Phe = Pentafluoro-Phenylalanine, Phe(3-F), 3-fluorophenylalanine
CCXLCCNPACXGCW

SEQ ID NO: 1576 - protein, 14 aa, Artificial Sequence
  Synthesized
  Modified Amino Acids (3)..(3): Xaa3 = Csa = Cysteic Acid
  Modified Amino Acids (11)..(11): Xaa11 = 4MeF3-Phe = Phe(4-MeF3), 4-trifluoromethylphenylalanine
CCXLCCNPACXGCW

SEQ ID NO: 1577 - protein, 14 aa, Artificial Sequence
  Synthesized
  Modified Amino Acid (12)..(12): Xaa12 = D-Ala = D-Alanine
CCSLCCNPACAXCI

SEQ ID NO: 1578 - protein, 14 aa, Artificial Sequence
  Synthesized
  Modified Amino Acid (12)..(12): Xaa12 = D-Ala = D-Alanine
CCSLCCNPACAXCW

SEQ ID NO: 1579 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXLCCNPACAXCI

SEQ ID NO: 1580 - protein, 14 aa, Artificial Sequence
  Synthesized
  Modified Amino Acids (3)..(3): Xaa3 = hSer = Homoserine, Hse
  Modified Amino Acids (12)..(12): Xaa12 = D-Ala = D-Alanine
CCXLCCNPACAXCW

SEQ ID NO: 1581 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXLCCNPACAXCI

SEQ ID NO: 1582 - protein, 14 aa, Artificial Sequence
  Synthesized
  Modified Amino Acids (3)..(3): Xaa3 = Csa = Cysteic Acid
  Modified Amino Acids (12)..(12): Xaa12 = D-Ala = D-Alanine
CCXLCCNPACAXCW

SEQ ID NO: 1583 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCETCCNXACTGCY

SEQ ID NO: 1584 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCETCCNXACSGCY

SEQ ID NO: 1585 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCETCCNXACXGCY

SEQ ID NO: 1586 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCETCCNXACXGCY

SEQ ID NO: 1587 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCETCCNXACXGCY

SEQ ID NO: 1588 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCETCCNXACXGCY

SEQ ID NO: 1589 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCETCCNXACXGCY

SEQ ID NO: 1590 - protein, 14 aa, Artificial Sequence
  Synthesized
  Modified Amino Acid (8)..(8): Xaa8 = Thz = Thiazolidine (4-thiazolidine-2-carboxylic acid), Tzd
CCETCCNXACTGCY

SEQ ID NO: 1591 - protein, 14 aa, Artificial Sequence
  Synthesized
  Modified Amino Acid (8)..(8): Xaa8 = Thz = Thiazolidine (4-thiazolidine-2-carboxylic acid), Tzd
CCETCCNXACSGCY

SEQ ID NO: 1592 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCETCCNXACXGCY

SEQ ID NO: 1593 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCETCCNXACXGCY

SEQ ID NO: 1594 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCETCCNXACXGCY

SEQ ID NO: 1595 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCETCCNXACXGCY

SEQ ID NO: 1596 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCETCCNXACXGCY

SEQ ID NO: 1597 - protein, 14 aa, Artificial Sequence
  Synthesized
  Modified Amino Acid (8)..(8): Xaa8 = HyPro = Hydroxy-Proline, Hyp, Hydroxyproline
CCETCCNXACTGCY

SEQ ID NO: 1598 - protein, 14 aa, Artificial Sequence
  Synthesized
  Modified Amino Acid (8)..(8): Xaa8 = HyPro = Hydroxy-Proline, Hyp, Hydroxyproline
CCETCCNXACSGCY

SEQ ID NO: 1599 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCETCCNXACXGCY

SEQ ID NO: 1600 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCETCCNXACXGCY

SEQ ID NO: 1601 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCETCCNXACXGCY

SEQ ID NO: 1602 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCETCCNXACXGCY

SEQ ID NO: 1603 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCETCCNXACXGCY

SEQ ID NO: 1604 - protein, 14 aa, Artificial Sequence
  Synthesized
  Modified Amino Acid (8)..(8): Xaa8 = Pip = L-Pipecolic Acid
CCETCCNXACTGCY

SEQ ID NO: 1605 - protein, 14 aa, Artificial Sequence
  Synthesized
  Modified Amino Acid (8)..(8): Xaa8 = Pip = L-Pipecolic Acid
CCETCCNXACSGCY

SEQ ID NO: 1606 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCETCCNXACXGCY

SEQ ID NO: 1607 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCETCCNXACXGCY

SEQ ID NO: 1608 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCETCCNXACXGCY

SEQ ID NO: 1609 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCETCCNXACXGCY

SEQ ID NO: 1610 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCETCCNXACXGCY

SEQ ID NO: 1611 - protein, 14 aa, Artificial Sequence
  Synthesized
CCETCCNIACTGCY

SEQ ID NO: 1612 - protein, 14 aa, Artificial Sequence
  Synthesized
CCETCCNIACSGCY

SEQ ID NO: 1613 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCETCCNIACXGCY

SEQ ID NO: 1614 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCETCCNIACXGCY

SEQ ID NO: 1615 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCETCCNIACXGCY

SEQ ID NO: 1616 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCETCCNIACXGCY

SEQ ID NO: 1617 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCETCCNIACXGCY

SEQ ID NO: 1618 - protein, 14 aa, Artificial Sequence
  Synthesized
CCETCCNAACTGCY

SEQ ID NO: 1619 - protein, 14 aa, Artificial Sequence
  Synthesized
CCETCCNAACSGCY

SEQ ID NO: 1620 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCETCCNAACXGCY

SEQ ID NO: 1621 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCETCCNAACXGCY

SEQ ID NO: 1622 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCETCCNAACXGCY

SEQ ID NO: 1623 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCETCCNAACXGCY

SEQ ID NO: 1624 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCETCCNAACXGCY

SEQ ID NO: 1625 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCETCCNXACAXCY

SEQ ID NO: 1626 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCETCCNXACAXCY

SEQ ID NO: 1627 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCETCCNXACAXCY

SEQ ID NO: 1628 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCETCCNXACAXCY

SEQ ID NO: 1629 - protein, 14 aa, Artificial Sequence
  Synthesized
  Modified Amino Acid (12)..(12): Xaa12 = D-Ala = D-Alanine
CCETCCNIACAXCY

SEQ ID NO: 1630 - protein, 14 aa, Artificial Sequence
  Synthesized
  Modified Amino Acid (12)..(12): Xaa12 = D-Ala = D-Alanine
CCETCCNAACAXCY

SEQ ID NO: 1631 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCETCCNXACAGCI

SEQ ID NO: 1632 - protein, 14 aa, Artificial Sequence
  Synthesized
  Modified Amino Acid (8)..(8): Xaa8 = Thz = Thiazolidine (4-thiazolidine-2-carboxylic acid), Tzd
CCETCCNXACAGCI

SEQ ID NO: 1633 - protein, 14 aa, Artificial Sequence
  Synthesized
  Modified Amino Acid (8)..(8): Xaa8 = HyPro = Hydroxy-Proline, Hyp, Hydroxyproline
CCETCCNXACAGCI

SEQ ID NO: 1634 - protein, 14 aa, Artificial Sequence
  Synthesized
  Modified Amino Acid (8)..(8): Xaa8 = Pip = L-Pipecolic Acid
CCETCCNXACAGCI

SEQ ID NO: 1635 - protein, 14 aa, Artificial Sequence
  Synthesized
CCETCCNIACAGCI

SEQ ID NO: 1636 - protein, 14 aa, Artificial Sequence
  Synthesized
CCETCCNAACAGCI

SEQ ID NO: 1637 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCETCCNXACAGCW

SEQ ID NO: 1638 - protein, 14 aa, Artificial Sequence
  Synthesized
  Modified Amino Acid (8)..(8): Xaa8 = Thz = Thiazolidine (4-thiazolidine-2-carboxylic acid), Tzd
CCETCCNXACAGCW

SEQ ID NO: 1639 - protein, 14 aa, Artificial Sequence
  Synthesized
  Modified Amino Acid (8)..(8): Xaa8 = HyPro = Hydroxy-Proline, Hyp, Hydroxyproline
CCETCCNXACAGCW

SEQ ID NO: 1640 - protein, 14 aa, Artificial Sequence
  Synthesized
  Modified Amino Acid (8)..(8): Xaa8 = Pip = L-Pipecolic Acid
CCETCCNXACAGCW

SEQ ID NO: 1641 - protein, 14 aa, Artificial Sequence
  Synthesized
CCETCCNIACAGCW

SEQ ID NO: 1642 - protein, 14 aa, Artificial Sequence
  Synthesized
CCETCCNAACAGCW

SEQ ID NO: 1643 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
CCEXCCNXACTGCY

SEQ ID NO: 1644 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
CCEXCCNXACSGCY

SEQ ID NO: 1645 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1646 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1647 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
  Modified Amino Acids (11)..(11): Xaa8 = Dhp = 3,4,-dihydro-Proline, D-Pro 3,4-Dehydroproline Xaa11 = 4NO2-Phe = 4-nitro-Phenylalanine, Phe(4-NO2), 4-Nitrophenylalanine
CCEXCCNXACXGCY

SEQ ID NO: 1648 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
  Modified Amino Acids (11)..(11): Xaa8 = Dhp = 3,4,-dihydro-Proline, D-Pro 3,4-Dehydroproline Xaa11 = 5F-Phe = Pentafluoro-Phenylalanine, Phe(3-F), 3-fluorophenylalanine
CCEXCCNXACXGCY

SEQ ID NO: 1649 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 1650 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
CCEXCCNXACTGCY

SEQ ID NO: 1651 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
CCEXCCNXACSGCY

SEQ ID NO: 1652 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1653 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
  Modified Amino Acids (11)..(11): Xaa8 = Thz = Thiazolidine (4-thiazolidine-2-carboxylic acid), Tzd Xaa11 = 4MeO-Phe = 4-methoxy-Phenylalanine, Phe(4-OMe), 4-methoxyphenylalanine
CCEXCCNXACXGCY

SEQ ID NO: 1654 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1655 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1656 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCEXCCNXACXGCY

SEQ ID NO: 1657 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
CCEXCCNXACTGCY

SEQ ID NO: 1658 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
CCEXCCNXACSGCY

SEQ ID NO: 1659 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1660 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1661 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1662 - protein, 14 aa, Artificial Sequence
  Synthesized
  Modified Amino Acids (4)..(8): Xaa4 = hLeu = Homoleucine, Hle Xaa8 = HyPro = Hydroxy-Proline, Hyp, Hydroxyproline Xaa11 = 5F-Phe = Pentafluoro-Phenylalanine, Phe(3-F), 3-fluorophenylalanine
  Modified Amino Acids (4)..(8): Xaa4 = hLeu = Homoleucine, Hle Xaa8 = HyPro = Hydroxy-Proline, Hyp, Hydroxyproline Xaa11 = 5F-Phe = Pentafluoro-Phenylalanine, Phe(3-F), 3-fluorophenylalanine
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1663 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 1664 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
CCEXCCNXACTGCY

SEQ ID NO: 1665 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
CCEXCCNXACSGCY

SEQ ID NO: 1666 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1667 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1668 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1669 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1670 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
  Modified Amino Acids (11)..(11): Xaa8 = Pip = L-Pipecolic Acid Xaa11 = 4MeF3-Phe = Phe(4-MeF3), 4-trifluoromethylphenylalanine
CCEXCCNXACXGCY

SEQ ID NO: 1671 - protein, 14 aa, Artificial Sequence
  Synthesized
  Modified Amino Acid (4)..(4): Xaa4 = hLeu = Homoleucine, Hle
CCEXCCNIACTGCY

SEQ ID NO: 1672 - protein, 14 aa, Artificial Sequence
  Synthesized
  Modified Amino Acid (4)..(4): Xaa4 = hLeu = Homoleucine, Hle
CCEXCCNIACSGCY

SEQ ID NO: 1673 - protein, 14 aa, Artificial Sequence
  Synthesized
  Modified Amino Acids (4)..(4): Xaa4 = hLeu = Homoleucine, Hle
  Modified Amino Acids (11)..(11): Xaa4 = hLeu = Homoleucine, Hle
CCEXCCNIACXGCY

SEQ ID NO: 1674 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
CCEXCCNIACXGCY

SEQ ID NO: 1675 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
CCEXCCNIACXGCY

SEQ ID NO: 1676 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
CCEXCCNIACXGCY

SEQ ID NO: 1677 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
CCEXCCNIACXGCY

SEQ ID NO: 1678 - protein, 14 aa, Artificial Sequence
  Synthesized
  Modified Amino Acid (4)..(4): Xaa4 = hLeu = Homoleucine, Hle
CCEXCCNAACTGCY

SEQ ID NO: 1679 - protein, 14 aa, Artificial Sequence
  Synthesized
  Modified Amino Acid (4)..(4): Xaa4 = hLeu = Homoleucine, Hle
CCEXCCNAACSGCY

SEQ ID NO: 1680 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
CCEXCCNAACXGCY

SEQ ID NO: 1681 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
CCEXCCNAACXGCY

SEQ ID NO: 1682 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
CCEXCCNAACXGCY

SEQ ID NO: 1683 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
CCEXCCNAACXGCY

SEQ ID NO: 1684 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
CCEXCCNAACXGCY

SEQ ID NO: 1685 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCEXCCNXACAXCY

SEQ ID NO: 1686 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
  Modified Amino Acids (12)..(12): Xaa8 = Thz = Thiazolidine (4-thiazolidine-2-carboxylic acid), Tzd
CCEXCCNXACAXCY

SEQ ID NO: 1687 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCEXCCNXACAXCY

SEQ ID NO: 1688 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
  Modified Amino Acids (12)..(12): Xaa12 = D-Ala = D-Alanine
CCEXCCNXACAXCY

SEQ ID NO: 1689 - protein, 14 aa, Artificial Sequence
  Synthesized
  Modified Amino Acids (4)..(4): Xaa4 = hLeu = Homoleucine, Hle
  Modified Amino Acids (12)..(12): Xaa12 = D-Ala = D-Alanine
CCEXCCNIACAXCY

SEQ ID NO: 1690 - protein, 14 aa, Artificial Sequence
  Synthesized
  Modified Amino Acids (4)..(4): Xaa4 = hLeu = Homoleucine, Hle
  Modified Amino Acids (12)..(12): Xaa12 = D-Ala = D-Alanine
CCEXCCNAACAXCY

SEQ ID NO: 1691 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
CCEXCCNXACAGCI

SEQ ID NO: 1692 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
CCEXCCNXACAGCI

SEQ ID NO: 1693 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
CCEXCCNXACAGCI

SEQ ID NO: 1694 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
CCEXCCNXACAGCI

SEQ ID NO: 1695 - protein, 14 aa, Artificial Sequence
  Synthesized
  Modified Amino Acid (4)..(4): Xaa4 = hLeu = Homoleucine, Hle
CCEXCCNIACAGCI

SEQ ID NO: 1696 - protein, 14 aa, Artificial Sequence
  Synthesized
  Modified Amino Acid (4)..(4): Xaa4 = hLeu = Homoleucine, Hle
CCEXCCNAACAGCI

SEQ ID NO: 1697 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Dhp = 3,4,-dihydro-Proline, D-Pro 3,4-Dehydroproline
CCEXCCNXACAGCW

SEQ ID NO: 1698 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Thz = Thiazolidine (4-thiazolidine-2-carboxylic acid), Tzd
CCEXCCNXACAGCW

SEQ ID NO: 1699 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = HyPro = Hydroxy-Proline, Hyp, Hydroxyproline
CCEXCCNXACAGCW

SEQ ID NO: 1700 - protein, 14 aa, Artificial Sequence
  Synthesized
  Modified Amino Acids (4)..(4): Xaa4 = hLeu = Homoleucine, Hle
  Modified Amino Acids (8)..(8): Xaa8 = Pip = L-Pipecolic Acid
CCEXCCNXACAGCW

SEQ ID NO: 1701 - protein, 14 aa, Artificial Sequence
  Synthesized
  Modified Amino Acid (4)..(4): Xaa4 = hLeu = Homoleucine, Hle
CCEXCCNIACAGCW

SEQ ID NO: 1702 - protein, 14 aa, Artificial Sequence
  Synthesized
  Modified Amino Acid (4)..(4): Xaa4 = hLeu = Homoleucine, Hle
CCEXCCNAACAGCW

SEQ ID NO: 1703 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
CCEXCCNXACTGCY

SEQ ID NO: 1704 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
CCEXCCNXACSGCY

SEQ ID NO: 1705 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1706 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1707 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1708 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1709 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 1710 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
CCEXCCNXACTGCY

SEQ ID NO: 1711 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
CCEXCCNXACSGCY

SEQ ID NO: 1712 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1713 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1714 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1715 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1716 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCEXCCNXACXGCY

SEQ ID NO: 1717 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
CCEXCCNXACTGCY

SEQ ID NO: 1718 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
CCEXCCNXACSGCY

SEQ ID NO: 1719 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1720 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1721 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
  Modified Amino Acids (11)..(11): Xaa8 = HyPro = Hydroxy-Proline, Hyp, Hydroxyproline Xaa11 = 4NO2-Phe = 4-nitro-Phenylalanine, Phe(4-NO2), 4-Nitrophenylalanine
CCEXCCNXACXGCY

SEQ ID NO: 1722 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1723 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 1724 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
CCEXCCNXACTGCY

SEQ ID NO: 1725 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
CCEXCCNXACSGCY

SEQ ID NO: 1726 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1727 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1728 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1729 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1730 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCEXCCNXACXGCY

SEQ ID NO: 1731 - protein, 14 aa, Artificial Sequence
  Synthesized
  Modified Amino Acid (4)..(4): Xaa4 = norLeu = Norleucine, Nle
CCEXCCNIACTGCY

SEQ ID NO: 1732 - protein, 14 aa, Artificial Sequence
  Synthesized
  Modified Amino Acid (4)..(4): Xaa4 = norLeu = Norleucine, Nle
CCEXCCNIACSGCY

SEQ ID NO: 1733 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
CCEXCCNIACXGCY

SEQ ID NO: 1734 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
CCEXCCNIACXGCY

SEQ ID NO: 1735 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
CCEXCCNIACXGCY

SEQ ID NO: 1736 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
CCEXCCNIACXGCY

SEQ ID NO: 1737 - protein, 14 aa, Artificial Sequence
  Synthesized
  Modified Amino Acids (4)..(11): Xaa4 = norLeu = Norleucine, Nle Xaa11 = 4MeF3-Phe = Phe(4-MeF3), 4-trifluoromethylphenylalanine
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
CCEXCCNIACXGCY

SEQ ID NO: 1738 - protein, 14 aa, Artificial Sequence
  Synthesized
  Modified Amino Acid (4)..(4): Xaa4 = norLeu = Norleucine, Nle
CCEXCCNAACTGCY

SEQ ID NO: 1739 - protein, 14 aa, Artificial Sequence
  Synthesized
  Modified Amino Acid (4)..(4): Xaa4 = norLeu = Norleucine, Nle
CCEXCCNAACSGCY

SEQ ID NO: 1740 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
CCEXCCNAACXGCY

SEQ ID NO: 1741 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
CCEXCCNAACXGCY

SEQ ID NO: 1742 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
CCEXCCNAACXGCY

SEQ ID NO: 1743 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
CCEXCCNAACXGCY

SEQ ID NO: 1744 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
CCEXCCNAACXGCY

SEQ ID NO: 1745 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCEXCCNXACAXCY

SEQ ID NO: 1746 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCEXCCNXACAXCY

SEQ ID NO: 1747 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCEXCCNXACAXCY

SEQ ID NO: 1748 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
  Modified Amino Acids (12)..(12): Xaa12 = D-Ala = D-Alanine
CCEXCCNXACAXCY

SEQ ID NO: 1749 - protein, 14 aa, Artificial Sequence
  Synthesized
  Modified Amino Acids (4)..(4): Xaa4 = norLeu = Norleucine, Nle
  Modified Amino Acids (12)..(12): Xaa12 = D-Ala = D-Alanine
CCEXCCNIACAXCY

SEQ ID NO: 1750 - protein, 14 aa, Artificial Sequence
  Synthesized
  Modified Amino Acids (4)..(4): Xaa4 = norLeu = Norleucine, Nle
  Modified Amino Acids (12)..(12): Xaa12 = D-Ala = D-Alanine
CCEXCCNAACAXCY

SEQ ID NO: 1751 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
CCEXCCNXACAGCI

SEQ ID NO: 1752 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
CCEXCCNXACAGCI

SEQ ID NO: 1753 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
CCEXCCNXACAGCI

SEQ ID NO: 1754 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Pip = L-Pipecolic Acid
CCEXCCNXACAGCI

SEQ ID NO: 1755 - protein, 14 aa, Artificial Sequence
  Synthesized
  Modified Amino Acid (4)..(4): Xaa4 = norLeu = Norleucine, Nle
CCEXCCNIACAGCI

SEQ ID NO: 1756 - protein, 14 aa, Artificial Sequence
  Synthesized
  Modified Amino Acid (4)..(4): Xaa4 = norLeu = Norleucine, Nle
CCEXCCNAACAGCI

SEQ ID NO: 1757 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Dhp = 3,4,-dihydro-Proline, D-Pro 3,4-Dehydroproline
CCEXCCNXACAGCW

SEQ ID NO: 1758 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = Thz = Thiazolidine (4-thiazolidine-2-carboxylic acid), Tzd
CCEXCCNXACAGCW

SEQ ID NO: 1759 - protein, 14 aa, Artificial Sequence
  Synthesized
  Modified Amino Acids (4)..(4): Xaa4 = norLeu = Norleucine, Nle
  Modified Amino Acids (8)..(8): Xaa8 = HyPro = Hydroxy-Proline, Hyp, Hydroxyproline
CCEXCCNXACAGCW

SEQ ID NO: 1760 - protein, 14 aa, Artificial Sequence
  Synthesized
  Modified Amino Acids (4)..(4): Xaa4 = norLeu = Norleucine, Nle
  Modified Amino Acids (8)..(8)
CCEXCCNXACAGCW

SEQ ID NO: 1761 - protein, 14 aa, Artificial Sequence
  Synthesized
  Modified Amino Acid (4)..(4): Xaa4 = norLeu = Norleucine, Nle
CCEXCCNIACAGCW

SEQ ID NO: 1762 - protein, 14 aa, Artificial Sequence
  Synthesized
  Modified Amino Acid (4)..(4): Xaa4 = norLeu = Norleucine, Nle
CCEXCCNAACAGCW

SEQ ID NO: 1763 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
CCEXCCNXACTGCY

SEQ ID NO: 1764 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
CCEXCCNXACSGCY

SEQ ID NO: 1765 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1766 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1767 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1768 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1769 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalaninee
CCEXCCNXACXGCY

SEQ ID NO: 1770 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
CCEXCCNXACTGCY

SEQ ID NO: 1771 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
CCEXCCNXACSGCY

SEQ ID NO: 1772 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1773 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1774 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1775 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1776 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCEXCCNXACXGCY

SEQ ID NO: 1777 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
CCEXCCNXACTGCY

SEQ ID NO: 1778 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
CCEXCCNXACSGCY

SEQ ID NO: 1779 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1780 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1781 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1782 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1783 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 1784 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
CCEXCCNXACTGCY

SEQ ID NO: 1785 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
CCEXCCNXACSGCY

SEQ ID NO: 1786 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1787 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1788 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1789 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1790 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCEXCCNXACXGCY

SEQ ID NO: 1791 - protein, 14 aa, Artificial Sequence
  Synthesized
  Modified Amino Acid (4)..(4): Xaa4 = ChxAla = Cyclohexyl-Aalanine, Cha
CCEXCCNIACTGCY

SEQ ID NO: 1792 - protein, 14 aa, Artificial Sequence
  Synthesized
  Modified Amino Acid (4)..(4): Xaa4 = ChxAla = Cyclohexyl-Aalanine, Cha
CCEXCCNIACSGCY

SEQ ID NO: 1793 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
CCEXCCNIACXGCY

SEQ ID NO: 1794 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
CCEXCCNIACXGCY

SEQ ID NO: 1795 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
CCEXCCNIACXGCY

SEQ ID NO: 1796 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
CCEXCCNIACXGCY

SEQ ID NO: 1797 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
CCEXCCNIACXGCY

SEQ ID NO: 1798 - protein, 14 aa, Artificial Sequence
  Synthesized
  Modified Amino Acid (4)..(4): Xaa4 = ChxAla = Cyclohexyl-Aalanine, Cha
CCEXCCNAACTGCY

SEQ ID NO: 1799 - protein, 14 aa, Artificial Sequence
  Synthesized
  Modified Amino Acid (4)..(4): Xaa4 = ChxAla = Cyclohexyl-Aalanine, Cha
CCEXCCNAACSGCY

SEQ ID NO: 1800 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
CCEXCCNAACXGCY

SEQ ID NO: 1801 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
CCEXCCNAACXGCY

SEQ ID NO: 1802 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
CCEXCCNAACXGCY

SEQ ID NO: 1803 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
CCEXCCNAACXGCY

SEQ ID NO: 1804 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
CCEXCCNAACXGCY

SEQ ID NO: 1805 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCEXCCNXACAXCY

SEQ ID NO: 1806 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCEXCCNXACAXCY

SEQ ID NO: 1807 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCEXCCNXACAXCY

SEQ ID NO: 1808 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
  Modified Amino Acids (12)..(12): Xaa12 = D-Ala = D-Alanine
CCEXCCNXACAXCY

SEQ ID NO: 1809 - protein, 14 aa, Artificial Sequence
  Synthesized
  Modified Amino Acids (4)..(4): Xaa4 = ChxAla = Cyclohexyl-Aalanine, Cha
  Modified Amino Acids (12)..(12): Xaa12 = D-Ala = D-Alanine
CCEXCCNIACAXCY

SEQ ID NO: 1810 - protein, 14 aa, Artificial Sequence
  Synthesized
  Modified Amino Acids (4)..(4): Xaa4 = ChxAla = Cyclohexyl-Aalanine, Cha
  Modified Amino Acids (12)..(12): Xaa12 = D-Ala = D-Alanine
CCEXCCNAACAXCY

SEQ ID NO: 1811 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
CCEXCCNXACAGCI

SEQ ID NO: 1812 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
CCEXCCNXACAGCI

SEQ ID NO: 1813 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
CCEXCCNXACAGCI

SEQ ID NO: 1814 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
CCEXCCNXACAGCI

SEQ ID NO: 1815 - protein, 14 aa, Artificial Sequence
  Synthesized
  Modified Amino Acid (4)..(4): Xaa4 = ChxAla = Cyclohexyl-Aalanine, Cha
CCEXCCNIACAGCI

SEQ ID NO: 1816 - protein, 14 aa, Artificial Sequence
  Synthesized
  Modified Amino Acid (4)..(4): Xaa4 = ChxAla = Cyclohexyl-Aalanine, Cha
CCEXCCNAACAGCI

SEQ ID NO: 1817 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Dhp = 3,4,-dihydro-Proline, D-Pro 3,4-Dehydroproline
CCEXCCNXACAGCW

SEQ ID NO: 1818 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Thz = Thiazolidine (4-thiazolidine-2-carboxylic acid), Tzd
CCEXCCNXACAGCW

SEQ ID NO: 1819 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = HyPro = Hydroxy-Proline, Hyp, Hydroxyproline
CCEXCCNXACAGCW

SEQ ID NO: 1820 - protein, 14 aa, Artificial Sequence
  Synthesized
  Modified Amino Acids (4)..(4): Xaa4 = ChxAla = Cyclohexyl-Aalanine, Cha
  Modified Amino Acids (8)..(8): Xaa8 = Pip = L-Pipecolic Acid
CCEXCCNXACAGCW

SEQ ID NO: 1821 - protein, 14 aa, Artificial Sequence
  Synthesized
  Modified Amino Acid (4)..(4): Xaa4 = ChxAla = Cyclohexyl-Aalanine, Cha
CCEXCCNIACAGCW

SEQ ID NO: 1822 - protein, 14 aa, Artificial Sequence
  Synthesized
  Modified Amino Acid (4)..(4): Xaa4 = ChxAla = Cyclohexyl-Aalanine, Cha
CCEXCCNAACAGCW

SEQ ID NO: 1823 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
CCEXCCNXACTGCY

SEQ ID NO: 1824 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
CCEXCCNXACSGCY

SEQ ID NO: 1825 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1826 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1827 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1828 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1829 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 1830 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
CCEXCCNXACTGCY

SEQ ID NO: 1831 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
CCEXCCNXACSGCY

SEQ ID NO: 1832 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1833 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1834 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1835 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanineTzd
CCEXCCNXACXGCY

SEQ ID NO: 1836 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCEXCCNXACXGCY

SEQ ID NO: 1837 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
CCEXCCNXACTGCY

SEQ ID NO: 1838 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
CCEXCCNXACSGCY

SEQ ID NO: 1839 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1840 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1841 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1842 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1843 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 1844 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
CCEXCCNXACTGCY

SEQ ID NO: 1845 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
CCEXCCNXACSGCY

SEQ ID NO: 1846 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 1847 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 1848 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 1849 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 1850 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCEXCCNXACXGCY

SEQ ID NO: 1851 - protein, 14 aa, Artificial Sequence
  Synthesized
  Modified Amino Acid (4)..(4): Xaa4 = ChxIle = Cyclohexyl-Isoleucine, Chi
CCEXCCNIACTGCY

SEQ ID NO: 1852 - protein, 14 aa, Artificial Sequence
  Synthesized
  Modified Amino Acid (4)..(4): Xaa4 = ChxIle = Cyclohexyl-Isoleucine, Chi
CCEXCCNIACSGCY

SEQ ID NO: 1853 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
CCEXCCNIACXGCY

SEQ ID NO: 1854 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
CCEXCCNIACXGCY

SEQ ID NO: 1855 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
CCEXCCNIACXGCY

SEQ ID NO: 1856 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
CCEXCCNIACXGCY

SEQ ID NO: 1857 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
CCEXCCNIACXGCY

SEQ ID NO: 1858 - protein, 14 aa, Artificial Sequence
  Synthesized
  Modified Amino Acid (4)..(4): Xaa4 = ChxIle = Cyclohexyl-Isoleucine, Chi
CCEXCCNAACTGCY

SEQ ID NO: 1859 - protein, 14 aa, Artificial Sequence
  Synthesized
  Modified Amino Acid (4)..(4): Xaa4 = ChxIle = Cyclohexyl-Isoleucine, Chi
CCEXCCNAACSGCY

SEQ ID NO: 1860 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
CCEXCCNAACXGCY

SEQ ID NO: 1861 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
CCEXCCNAACXGCY

SEQ ID NO: 1862 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
CCEXCCNAACXGCY

SEQ ID NO: 1863 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
CCEXCCNAACXGCY

SEQ ID NO: 1864 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
CCEXCCNAACXGCY

SEQ ID NO: 1865 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCEXCCNXACAXCY

SEQ ID NO: 1866 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCEXCCNXACAXCY

SEQ ID NO: 1867 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCEXCCNXACAXCY

SEQ ID NO: 1868 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
  Modified Amino Acids (12)..(12): Xaa12 = D-Ala = D-Alanine
CCEXCCNXACAXCY

SEQ ID NO: 1869 - protein, 14 aa, Artificial Sequence
  Synthesized
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCEXCCNIACAXCY

SEQ ID NO: 1870 - protein, 14 aa, Artificial Sequence
  Synthesized
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCEXCCNAACAXCY

SEQ ID NO: 1871 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
CCEXCCNXACAGCI

SEQ ID NO: 1872 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
CCEXCCNXACAGCI

SEQ ID NO: 1873 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
CCEXCCNXACAGCI

SEQ ID NO: 1874 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
CCEXCCNXACAGCI

SEQ ID NO: 1875 - protein, 14 aa, Artificial Sequence
  Synthesized
  Modified Amino Acid (4)..(4): Xaa4 = ChxIle = Cyclohexyl-Isoleucine, Chi
CCEXCCNIACAGCI

SEQ ID NO: 1876 - protein, 14 aa, Artificial Sequence
  Synthesized
  Modified Amino Acid (4)..(4): Xaa4 = ChxIle = Cyclohexyl-Isoleucine, Chi
CCEXCCNAACAGCI

SEQ ID NO: 1877 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Dhp = 3,4,-dihydro-Proline, D-Pro 3,4-Dehydroproline
CCEXCCNXACAGCW

SEQ ID NO: 1878 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Thz = Thiazolidine (4-thiazolidine-2-carboxylic acid), Tzd
CCEXCCNXACAGCW

SEQ ID NO: 1879 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = HyPro = Hydroxy-Proline, Hyp, Hydroxyproline
CCEXCCNXACAGCW

SEQ ID NO: 1880 - protein, 14 aa, Artificial Sequence
  Synthesized
  Modified Amino Acids (4)..(4): Xaa4 = ChxIle = Cyclohexyl-Isoleucine, Chi
  Modified Amino Acids (8)..(8): Xaa8 = Pip = L-Pipecolic Acid
CCEXCCNXACAGCW

SEQ ID NO: 1881 - protein, 14 aa, Artificial Sequence
  Synthesized
  Modified Amino Acid (4)..(4): Xaa4 = ChxIle = Cyclohexyl-Isoleucine, Chi
CCEXCCNIACAGCW

SEQ ID NO: 1882 - protein, 14 aa, Artificial Sequence
  Synthesized
  Modified Amino Acid (4)..(4): Xaa4 = ChxIle = Cyclohexyl-Isoleucine, Chi
CCEXCCNAACAGCW

SEQ ID NO: 1883 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEFCCNXACTGCY

SEQ ID NO: 1884 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEFCCNXACSGCY

SEQ ID NO: 1885 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCEFCCNXACXGCY

SEQ ID NO: 1886 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCEFCCNXACXGCY

SEQ ID NO: 1887 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCEFCCNXACXGCY

SEQ ID NO: 1888 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCEFCCNXACXGCY

SEQ ID NO: 1889 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCEFCCNXACXGCY

SEQ ID NO: 1890 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEFCCNXACTGCY

SEQ ID NO: 1891 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEFCCNXACSGCY

SEQ ID NO: 1892 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCEFCCNXACXGCY

SEQ ID NO: 1893 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCEFCCNXACXGCY

SEQ ID NO: 1894 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCEFCCNXACXGCY

SEQ ID NO: 1895 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCEFCCNXACXGCY

SEQ ID NO: 1896 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCEFCCNXACXGCY

SEQ ID NO: 1897 - protein, 14 aa, Artificial Sequence
  Synthesized
  Modified Amino Acid (8)..(8): Xaa8 = HyPro = Hydroxy-Proline, Hyp, Hydroxyproline
CCEFCCNXACTGCY

SEQ ID NO: 1898 - protein, 14 aa, Artificial Sequence
  Synthesized
  Modified Amino Acid (8)..(8): Xaa8 = HyPro = Hydroxy-Proline, Hyp, Hydroxyproline
CCEFCCNXACSGCY

SEQ ID NO: 1899 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCEFCCNXACXGCY

SEQ ID NO: 1900 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCEFCCNXACXGCY

SEQ ID NO: 1901 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCEFCCNXACXGCY

SEQ ID NO: 1902 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCEFCCNXACXGCY

SEQ ID NO: 1903 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCEFCCNXACXGCY

SEQ ID NO: 1904 - protein, 14 aa, Artificial Sequence
  Synthesized
  Modified Amino Acid (8)..(8): Xaa8 = Pip = L-Pipecolic Acid
CCEFCCNXACTGCY

SEQ ID NO: 1905 - protein, 14 aa, Artificial Sequence
  Synthesized
  Modified Amino Acid (8)..(8): Xaa8 = Pip = L-Pipecolic Acid
CCEFCCNXACSGCY

SEQ ID NO: 1906 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCEFCCNXACXGCY

SEQ ID NO: 1907 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCEFCCNXACXGCY

SEQ ID NO: 1908 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCEFCCNXACXGCY

SEQ ID NO: 1909 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCEFCCNXACXGCY

SEQ ID NO: 1910 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCEFCCNXACXGCY

SEQ ID NO: 1911 - protein, 14 aa, Artificial Sequence
  Synthesized
CCEFCCNIACTGCY

SEQ ID NO: 1912 - protein, 14 aa, Artificial Sequence
  Synthesized
CCEFCCNIACSGCY

SEQ ID NO: 1913 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEFCCNIACXGCY

SEQ ID NO: 1914 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEFCCNIACXGCY

SEQ ID NO: 1915 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEFCCNIACXGCY

SEQ ID NO: 1916 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEFCCNIACXGCY

SEQ ID NO: 1917 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEFCCNIACXGCY

SEQ ID NO: 1918 - protein, 14 aa, Artificial Sequence
  Synthesized
CCEFCCNAACTGCY

SEQ ID NO: 1919 - protein, 14 aa, Artificial Sequence
  Synthesized
CCEFCCNAACSGCY

SEQ ID NO: 1920 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEFCCNAACXGCY

SEQ ID NO: 1921 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEFCCNAACXGCY

SEQ ID NO: 1922 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEFCCNAACXGCY

SEQ ID NO: 1923 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEFCCNAACXGCY

SEQ ID NO: 1924 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEFCCNAACXGCY

SEQ ID NO: 1925 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCEFCCNXACAXCY

SEQ ID NO: 1926 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCEFCCNXACAXCY

SEQ ID NO: 1927 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCEFCCNXACAXCY

SEQ ID NO: 1928 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCEFCCNXACAXCY

SEQ ID NO: 1929 - protein, 14 aa, Artificial Sequence
  Synthesized
  Modified Amino Acid (12)..(12): Xaa12 = D-Ala = D-Alanine
CCEFCCNIACAXCY

SEQ ID NO: 1930 - protein, 14 aa, Artificial Sequence
  Synthesized
  Modified Amino Acid (12)..(12): Xaa12 = D-Ala = D-Alanine
CCEFCCNAACAXCY

SEQ ID NO: 1931 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEFCCNXACAGCI

SEQ ID NO: 1932 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEFCCNXACAGCI

SEQ ID NO: 1933 - protein, 14 aa, Artificial Sequence
  Synthesized
  Modified Amino Acid (8)..(8): Xaa8 = HyPro = Hydroxy-Proline, Hyp, Hydroxyproline
CCEFCCNXACAGCI

SEQ ID NO: 1934 - protein, 14 aa, Artificial Sequence
  Synthesized
  Modified Amino Acid (8)..(8): Xaa8 = Pip = L-Pipecolic Acid
CCEFCCNXACAGCI

SEQ ID NO: 1935 - protein, 14 aa, Artificial Sequence
  Synthesized
CCEFCCNIACAGCI

SEQ ID NO: 1936 - protein, 14 aa, Artificial Sequence
  Synthesized
CCEFCCNAACAGCI

SEQ ID NO: 1937 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEFCCNXACAGCW

SEQ ID NO: 1938 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEFCCNXACAGCW

SEQ ID NO: 1939 - protein, 14 aa, Artificial Sequence
  Synthesized
  Modified Amino Acid (8)..(8): Xaa8 = HyPro = Hydroxy-Proline, Hyp, Hydroxyproline
CCEFCCNXACAGCW

SEQ ID NO: 1940 - protein, 14 aa, Artificial Sequence
  Synthesized
  Modified Amino Acid (8)..(8): Xaa8 = Pip = L-Pipecolic Acid
CCEFCCNXACAGCW

SEQ ID NO: 1941 - protein, 14 aa, Artificial Sequence
  Synthesized
CCEFCCNIACAGCW

SEQ ID NO: 1942 - protein, 14 aa, Artificial Sequence
  Synthesized
CCEFCCNAACAGCW

SEQ ID NO: 1943 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEYCCNXACTGCY

SEQ ID NO: 1944 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEYCCNXACSGCY

SEQ ID NO: 1945 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCEYCCNXACXGCY

SEQ ID NO: 1946 - protein, 14 aa, Artificial Sequence
  Synthesized
  Modified Amino Acids (8)..(11): Xaa8 = Dhp = 3,4,-dihydro-Proline, D-Pro 3,4-Dehydroproline Xaa11 = 4MeO-Phe = 4-methoxy-Phenylalanine, Phe(4-OMe), 4-methoxyphenylalanine
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCEYCCNXACXGCY

SEQ ID NO: 1947 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCEYCCNXACXGCY

SEQ ID NO: 1948 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCEYCCNXACXGCY

SEQ ID NO: 1949 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCEYCCNXACXGCY

SEQ ID NO: 1950 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEYCCNXACTGCY

SEQ ID NO: 1951 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEYCCNXACSGCY

SEQ ID NO: 1952 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCEYCCNXACXGCY

SEQ ID NO: 1953 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCEYCCNXACXGCY

SEQ ID NO: 1954 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCEYCCNXACXGCY

SEQ ID NO: 1955 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCEYCCNXACXGCY

SEQ ID NO: 1956 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCEYCCNXACXGCY

SEQ ID NO: 1957 - protein, 14 aa, Artificial Sequence
  Synthesized
  Modified Amino Acid (8)..(8): Xaa8 = HyPro = Hydroxy-Proline, Hyp, Hydroxyproline
CCEYCCNXACTGCY

SEQ ID NO: 1958 - protein, 14 aa, Artificial Sequence
  Synthesized
  Modified Amino Acid (8)..(8): Xaa8 = HyPro = Hydroxy-Proline, Hyp, Hydroxyproline
CCEYCCNXACSGCY

SEQ ID NO: 1959 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCEYCCNXACXGCY

SEQ ID NO: 1960 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCEYCCNXACXGCY

SEQ ID NO: 1961 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCEYCCNXACXGCY

SEQ ID NO: 1962 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCEYCCNXACXGCY

SEQ ID NO: 1963 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCEYCCNXACXGCY

SEQ ID NO: 1964 - protein, 14 aa, Artificial Sequence
  Synthesized
  Modified Amino Acid (8)..(8): Xaa8 = Pip = L-Pipecolic Acid
CCEYCCNXACTGCY

SEQ ID NO: 1965 - protein, 14 aa, Artificial Sequence
  Synthesized
  Modified Amino Acid (8)..(8): Xaa8 = Pip = L-Pipecolic Acid
CCEYCCNXACSGCY

SEQ ID NO: 1966 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCEYCCNXACXGCY

SEQ ID NO: 1967 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCEYCCNXACXGCY

SEQ ID NO: 1968 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCEYCCNXACXGCY

SEQ ID NO: 1969 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCEYCCNXACXGCY

SEQ ID NO: 1970 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCEYCCNXACXGCY

SEQ ID NO: 1971 - protein, 14 aa, Artificial Sequence
  Synthesized
CCEYCCNIACTGCY

SEQ ID NO: 1972 - protein, 14 aa, Artificial Sequence
  Synthesized
CCEYCCNIACSGCY

SEQ ID NO: 1973 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEYCCNIACXGCY

SEQ ID NO: 1974 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEYCCNIACXGCY

SEQ ID NO: 1975 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEYCCNIACXGCY

SEQ ID NO: 1976 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEYCCNIACXGCY

SEQ ID NO: 1977 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEYCCNIACXGCY

SEQ ID NO: 1978 - protein, 14 aa, Artificial Sequence
  Synthesized
CCEYCCNAACTGCY

SEQ ID NO: 1979 - protein, 14 aa, Artificial Sequence
  Synthesized
CCEYCCNAACSGCY

SEQ ID NO: 1980 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEYCCNAACXGCY

SEQ ID NO: 1981 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEYCCNAACXGCY

SEQ ID NO: 1982 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEYCCNAACXGCY

SEQ ID NO: 1983 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEYCCNAACXGCY

SEQ ID NO: 1984 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEYCCNAACXGCY

SEQ ID NO: 1985 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCEYCCNXACAXCY

SEQ ID NO: 1986 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCEYCCNXACAXCY

SEQ ID NO: 1987 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCEYCCNXACAXCY

SEQ ID NO: 1988 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCEYCCNXACAXCY

SEQ ID NO: 1989 - protein, 14 aa, Artificial Sequence
  Synthesized
  Modified Amino Acid (12)..(12): Xaa12 = D-Ala = D-Alanine
CCEYCCNIACAXCY

SEQ ID NO: 1990 - protein, 14 aa, Artificial Sequence
  Synthesized
  Modified Amino Acid (12)..(12): Xaa12 = D-Ala = D-Alanine
CCEYCCNAACAXCY

SEQ ID NO: 1991 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEYCCNXACAGCI

SEQ ID NO: 1992 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEYCCNXACAGCI

SEQ ID NO: 1993 - protein, 14 aa, Artificial Sequence
  Synthesized
  Modified Amino Acid (8)..(8): Xaa8 = HyPro = Hydroxy-Proline, Hyp, Hydroxyproline
CCEYCCNXACAGCI

SEQ ID NO: 1994 - protein, 14 aa, Artificial Sequence
  Synthesized
  Modified Amino Acid (8)..(8): Xaa8 = Pip = L-Pipecolic Acid
CCEYCCNXACAGCI

SEQ ID NO: 1995 - protein, 14 aa, Artificial Sequence
  Synthesized
CCEYCCNIACAGCI

SEQ ID NO: 1996 - protein, 14 aa, Artificial Sequence
  Synthesized
CCEYCCNAACAGCI

SEQ ID NO: 1997 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCEYCCNXACAGCW

SEQ ID NO: 1998 - protein, 14 aa, Artificial Sequence
  Synthesized
  Modified Amino Acid (8)..(8): Xaa8 = Thz = Thiazolidine (4-thiazolidine-2-carboxylic acid), Tzd
CCEYCCNXACAGCW

SEQ ID NO: 1999 - protein, 14 aa, Artificial Sequence
  Synthesized
  Modified Amino Acid (8)..(8): Xaa8 = HyPro = Hydroxy-Proline, Hyp, Hydroxyproline
CCEYCCNXACAGCW

SEQ ID NO: 2000 - protein, 14 aa, Artificial Sequence
  Synthesized
  Modified Amino Acid (8)..(8): Xaa8 = Pip = L-Pipecolic Acid
CCEYCCNXACAGCW

SEQ ID NO: 2001 - protein, 14 aa, Artificial Sequence
  Synthesized
CCEYCCNIACAGCW

SEQ ID NO: 2002 - protein, 14 aa, Artificial Sequence
  Synthesized
CCEYCCNAACAGCW

SEQ ID NO: 2003 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
CCEXCCNXACTGCY

SEQ ID NO: 2004 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
CCEXCCNXACSGCY

SEQ ID NO: 2005 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 2006 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 2007 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 2008 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 2009 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 2010 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
CCEXCCNXACTGCY

SEQ ID NO: 2011 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
CCEXCCNXACSGCY

SEQ ID NO: 2012 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 2013 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 2014 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 2015 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 2016 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCEXCCNXACXGCY

SEQ ID NO: 2017 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
CCEXCCNXACTGCY

SEQ ID NO: 2018 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
CCEXCCNXACSGCY

SEQ ID NO: 2019 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 2020 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 2021 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 2022 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
  Modified Amino Acids (11)..(11): Xaa8 = HyPro = Hydroxy-Proline, Hyp, Hydroxyproline Xaa11 = 5F-Phe = Pentafluoro-Phenylalanine, Phe(3-F), 3-fluorophenylalanine
CCEXCCNXACXGCY

SEQ ID NO: 2023 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
  Modified Amino Acids (11)..(11): Xaa8 = HyPro = Hydroxy-Proline, Hyp, Hydroxyproline Xaa11 = 4MeF3-Phe = Phe(4-MeF3), 4-trifluoromethylphenylalanine
CCEXCCNXACXGCY

SEQ ID NO: 2024 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
CCEXCCNXACTGCY

SEQ ID NO: 2025 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
CCEXCCNXACSGCY

SEQ ID NO: 2026 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 2027 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 2028 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 2029 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 2030 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCEXCCNXACXGCY

SEQ ID NO: 2031 - protein, 14 aa, Artificial Sequence
  Synthesized
  Modified Amino Acid (4)..(4): Xaa4 = Dopa = L-Dopa, L-dihydroxyphenylalanine
CCEXCCNIACTGCY

SEQ ID NO: 2032 - protein, 14 aa, Artificial Sequence
  Synthesized
  Modified Amino Acid (4)..(4): Xaa4 = Dopa = L-Dopa, L-dihydroxyphenylalanine
CCEXCCNIACSGCY

SEQ ID NO: 2033 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
CCEXCCNIACXGCY

SEQ ID NO: 2034 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
CCEXCCNIACXGCY

SEQ ID NO: 2035 - protein, 14 aa, Artificial Sequence
  Synthesized
  Modified Amino Acids (4)..(11): Xaa4 = Dopa = L-Dopa, L-dihydroxyphenylalanine Xaa11 = 4NO2-Phe = 4-nitro-Phenylalanine, Phe(4-NO2), 4-Nitrophenylalanine
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
CCEXCCNIACXGCY

SEQ ID NO: 2036 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
CCEXCCNIACXGCY

SEQ ID NO: 2037 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
CCEXCCNIACXGCY

SEQ ID NO: 2038 - protein, 14 aa, Artificial Sequence
  Synthesized
  Modified Amino Acid (4)..(4): Xaa4 = Dopa = L-Dopa, L-dihydroxyphenylalanine
CCEXCCNAACTGCY

SEQ ID NO: 2039 - protein, 14 aa, Artificial Sequence
  Synthesized
  Modified Amino Acid (4)..(4): Xaa4 = Dopa = L-Dopa, L-dihydroxyphenylalanine
CCEXCCNAACSGCY

SEQ ID NO: 2040 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
CCEXCCNAACXGCY

SEQ ID NO: 2041 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
CCEXCCNAACXGCY

SEQ ID NO: 2042 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
CCEXCCNAACXGCY

SEQ ID NO: 2043 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
CCEXCCNAACXGCY

SEQ ID NO: 2044 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
CCEXCCNAACXGCY

SEQ ID NO: 2045 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCEXCCNXACAXCY

SEQ ID NO: 2046 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCEXCCNXACAXCY

SEQ ID NO: 2047 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
  Modified Amino Acids (12)..(12): Xaa8 = HyPro = Hydroxy-Proline, Hyp, Hydroxyproline Xaa12 = D-Ala = D-Alanine
CCEXCCNXACAXCY

SEQ ID NO: 2048 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
  Modified Amino Acids (12)..(12): Xaa12 = D-Ala = D-Alanine
CCEXCCNXACAXCY

SEQ ID NO: 2049 - protein, 14 aa, Artificial Sequence
  Synthesized
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCEXCCNIACAXCY

SEQ ID NO: 2050 - protein, 14 aa, Artificial Sequence
  Synthesized
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCEXCCNAACAXCY

SEQ ID NO: 2051 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
CCEXCCNXACAGCI

SEQ ID NO: 2052 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
CCEXCCNXACAGCI

SEQ ID NO: 2053 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
CCEXCCNXACAGCI

SEQ ID NO: 2054 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
CCEXCCNXACAGCI

SEQ ID NO: 2055 - protein, 14 aa, Artificial Sequence
  Synthesized
  Modified Amino Acid (4)..(4): Xaa4 = Dopa = L-Dopa, L-dihydroxyphenylalanine
CCEXCCNIACAGCI

SEQ ID NO: 2056 - protein, 14 aa, Artificial Sequence
  Synthesized
  Modified Amino Acid (4)..(4): Xaa4 = Dopa = L-Dopa, L-dihydroxyphenylalanine
CCEXCCNAACAGCI

SEQ ID NO: 2057 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Dhp = 3,4,-dihydro-Proline, D-Pro 3,4-Dehydroproline
CCEXCCNXACAGCW

SEQ ID NO: 2058 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Thz = Thiazolidine (4-thiazolidine-2-carboxylic acid), Tzd
CCEXCCNXACAGCW

SEQ ID NO: 2059 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = HyPro = Hydroxy-Proline, Hyp, Hydroxyproline
CCEXCCNXACAGCW

SEQ ID NO: 2060 - protein, 14 aa, Artificial Sequence
  Synthesized
  Modified Amino Acids (4)..(4): Xaa4 = Dopa = L-Dopa, L-dihydroxyphenylalanine
  Modified Amino Acids (8)..(8): Xaa8 = Pip = L-Pipecolic Acid
CCEXCCNXACAGCW

SEQ ID NO: 2061 - protein, 14 aa, Artificial Sequence
  Synthesized
  Modified Amino Acid (4)..(4): Xaa4 = Dopa = L-Dopa, L-dihydroxyphenylalanine
CCEXCCNIACAGCW

SEQ ID NO: 2062 - protein, 14 aa, Artificial Sequence
  Synthesized
  Modified Amino Acid (4)..(4): Xaa4 = Dopa = L-Dopa, L-dihydroxyphenylalanine
CCEXCCNAACAGCW

SEQ ID NO: 2063 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
CCEXCCNXACTGCY

SEQ ID NO: 2064 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
CCEXCCNXACSGCY

SEQ ID NO: 2065 - protein, 14 aa, Artificial Sequence
  Synthesized
  misc_feature (4)..(4): Xaa can be any naturally occurring amino acid
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 2066 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 2067 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 2068 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 2069 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 2070 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
CCEXCCNXACTGCY

SEQ ID NO: 2071 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
CCEXCCNXACSGCY

SEQ ID NO: 2072 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 2073 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 2074 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 2075 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 2076 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCEXCCNXACXGCY

SEQ ID NO: 2077 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
CCEXCCNXACTGCY

SEQ ID NO: 2078 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
CCEXCCNXACSGCY

SEQ ID NO: 2079 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 2080 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 2081 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 2082 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 2083 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCEXCCNXACXGCY

SEQ ID NO: 2084 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
CCEXCCNXACTGCY

SEQ ID NO: 2085 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
CCEXCCNXACSGCY

SEQ ID NO: 2086 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCEXCCNXACXGCY

SEQ ID NO: 2087 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCEXCCNXACXGCY

SEQ ID NO: 2088 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCEXCCNXACXGCY

SEQ ID NO: 2089 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCEXCCNXACXGCY

SEQ ID NO: 2090 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCEXCCNXACXGCY

SEQ ID NO: 2091 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNIACTGCY

SEQ ID NO: 2092 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNIACSGCY

SEQ ID NO: 2093 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
CCEXCCNIACXGCY

SEQ ID NO: 2094 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
CCEXCCNIACXGCY

SEQ ID NO: 2095 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
CCEXCCNIACXGCY

SEQ ID NO: 2096 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalaninee
CCEXCCNIACXGCY

SEQ ID NO: 2097 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
CCEXCCNIACXGCY

SEQ ID NO: 2098 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNAACTGCY

SEQ ID NO: 2099 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNAACSGCY

SEQ ID NO: 2100 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
CCEXCCNAACXGCY

SEQ ID NO: 2101 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
CCEXCCNAACXGCY

SEQ ID NO: 2102 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
CCEXCCNAACXGCY

SEQ ID NO: 2103 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
CCEXCCNAACXGCY

SEQ ID NO: 2104 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalaninee
CCEXCCNAACXGCY

SEQ ID NO: 2105 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCEXCCNXACAXCY

SEQ ID NO: 2106 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCEXCCNXACAXCY

SEQ ID NO: 2107 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCEXCCNXACAXCY

SEQ ID NO: 2108 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
  Modified Amino Acids (12)..(12): Xaa12 = D-Ala = D-Alanine
CCEXCCNXACAXCY

SEQ ID NO: 2109 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCEXCCNIACAXCY

SEQ ID NO: 2110 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCEXCCNAACAXCY

SEQ ID NO: 2111 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
CCEXCCNXACAGCI

SEQ ID NO: 2112 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
CCEXCCNXACAGCI

SEQ ID NO: 2113 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
CCEXCCNXACAGCI

SEQ ID NO: 2114 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
CCEXCCNXACAGCI

SEQ ID NO: 2115 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNIACAGCI

SEQ ID NO: 2116 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNAACAGCI

SEQ ID NO: 2117 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Dhp = 3,4,-dihydro-Proline, D-Pro 3,4-Dehydroproline
CCEXCCNXACAGCW

SEQ ID NO: 2118 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Thz = Thiazolidine (4-thiazolidine-2-carboxylic acid), Tzd
CCEXCCNXACAGCW

SEQ ID NO: 2119 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = HyPro = Hydroxy-Proline, Hyp, Hydroxyproline
CCEXCCNXACAGCW

SEQ ID NO: 2120 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (8)..(8): Xaa8 = Pip = L-Pipecolic Acid
CCEXCCNXACAGCW

SEQ ID NO: 2121 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNIACAGCW

SEQ ID NO: 2122 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNAACAGCW

SEQ ID NO: 2123 - protein, 14 aa, Artificial Sequence
  Synthesized
  Modified Amino Acid (12)..(12): Xaa12 = D-Ala = D-Alanine
CCETCCNPACTXCY

SEQ ID NO: 2124 - protein, 14 aa, Artificial Sequence
  Synthesized
  Modified Amino Acid (12)..(12): Xaa12 = D-Ala = D-Alanine
CCETCCNPACSXCY

SEQ ID NO: 2125 - protein, 14 aa, Artificial Sequence
  Synthesized
  Modified Amino Acids (11)..(12): Xaa11 = 4F-Phe = 4-fluoro-Phenylalanine, Phe(4-F), 4-fluorophenylalanine Xaa12 = D-Ala = D-Alanine
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCETCCNPACXXCY

SEQ ID NO: 2126 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCETCCNPACXXCY

SEQ ID NO: 2127 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCETCCNPACXXCY

SEQ ID NO: 2128 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCETCCNPACXXCY

SEQ ID NO: 2129 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa11 = 4MeF3-Phe = Phe(4-MeF3), 4-trifluoromethylphenylalanine
CCETCCNPACXXCY

SEQ ID NO: 2130 - protein, 14 aa, Artificial Sequence
  Synthesized
CCETCCNPACTGCI

SEQ ID NO: 2131 - protein, 14 aa, Artificial Sequence
  Synthesized
CCETCCNPACSGCI

SEQ ID NO: 2132 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCETCCNPACXGCI

SEQ ID NO: 2133 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCETCCNPACXGCI

SEQ ID NO: 2134 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCETCCNPACXGCI

SEQ ID NO: 2135 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCETCCNPACXGCI

SEQ ID NO: 2136 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCETCCNPACXGCI

SEQ ID NO: 2137 - protein, 14 aa, Artificial Sequence
  Synthesized
CCETCCNPACTGCW

SEQ ID NO: 2138 - protein, 14 aa, Artificial Sequence
  Synthesized
CCETCCNPACSGCW

SEQ ID NO: 2139 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCETCCNPACXGCW

SEQ ID NO: 2140 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCETCCNPACXGCW

SEQ ID NO: 2141 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCETCCNPACXGCW

SEQ ID NO: 2142 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCETCCNPACXGCW

SEQ ID NO: 2143 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCETCCNPACXGCW

SEQ ID NO: 2144 - protein, 14 aa, Artificial Sequence
  Synthesized
  Modified Amino Acids (4)..(4): Xaa4 = hLeu = Homoleucine, Hle
  Modified Amino Acids (12)..(12): Xaa12 = D-Ala = D-Alanine
CCEXCCNPACTXCY

SEQ ID NO: 2145 - protein, 14 aa, Artificial Sequence
  Synthesized
  Modified Amino Acids (4)..(4): Xaa4 = hLeu = Homoleucine, Hle
  Modified Amino Acids (12)..(12): Xaa12 = D-Ala = D-Alanine
CCEXCCNPACSXCY

SEQ ID NO: 2146 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alaninee
CCEXCCNPACXXCY

SEQ ID NO: 2147 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCEXCCNPACXXCY

SEQ ID NO: 2148 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCEXCCNPACXXCY

SEQ ID NO: 2149 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCEXCCNPACXXCY

SEQ ID NO: 2150 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCEXCCNPACXXCY

SEQ ID NO: 2151 - protein, 14 aa, Artificial Sequence
  Synthesized
  Modified Amino Acid (4)..(4): Xaa4 = hLeu = Homoleucine, Hle
CCEXCCNPACTGCI

SEQ ID NO: 2152 - protein, 14 aa, Artificial Sequence
  Synthesized
  Modified Amino Acid (4)..(4): Xaa4 = hLeu = Homoleucine, Hle
CCEXCCNPACSGCI

SEQ ID NO: 2153 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
CCEXCCNPACXGCI

SEQ ID NO: 2154 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
CCEXCCNPACXGCI

SEQ ID NO: 2155 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
CCEXCCNPACXGCI

SEQ ID NO: 2156 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
CCEXCCNPACXGCI

SEQ ID NO: 2157 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
CCEXCCNPACXGCI

SEQ ID NO: 2158 - protein, 14 aa, Artificial Sequence
  Synthesized
  Modified Amino Acid (4)..(4): Xaa4 = hLeu = Homoleucine, Hle
CCEXCCNPACTGCW

SEQ ID NO: 2159 - protein, 14 aa, Artificial Sequence
  Synthesized
  Modified Amino Acid (4)..(4): Xaa4 = hLeu = Homoleucine, Hle
CCEXCCNPACSGCW

SEQ ID NO: 2160 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4F-Phe = 4-fluoro-Phenylalanine, Phe(4-F), 4-fluorophenylalanine
CCEXCCNPACXGCW

SEQ ID NO: 2161 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeO-Phe = 4-methoxy-Phenylalanine, Phe(4-OMe), 4-methoxyphenylalanine
CCEXCCNPACXGCW

SEQ ID NO: 2162 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4NO2-Phe = 4-nitro-Phenylalanine, Phe(4-NO2), 4-Nitrophenylalanine
CCEXCCNPACXGCW

SEQ ID NO: 2163 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 5F-Phe = Pentafluoro-Phenylalanine, Phe(3-F), 3-fluorophenylalanine
CCEXCCNPACXGCW

SEQ ID NO: 2164 - protein, 14 aa, Artificial Sequence
  Synthesized
  Modified Amino Acids (4)..(4): Xaa4 = hLeu = Homoleucine, Hle
  Modified Amino Acids (11)..(11): Xaa11 = 4MeF3-Phe = Phe(4-MeF3), 4-trifluoromethylphenylalanine
CCEXCCNPACXGCW

SEQ ID NO: 2165 - protein, 14 aa, Artificial Sequence
  Synthesized
  Modified Amino Acids (4)..(12): Xaa4 = norLeu = Norleucine, Nle Xaa12 = D-Ala = D-Alanine
  Modified Amino Acids (4)..(4): Xaa4 = norLeu = Norleucine, Nle
  Modified Amino Acids (12)..(12): Xaa12 = D-Ala = D-Alanine
CCEXCCNPACTXCY

SEQ ID NO: 2166 - protein, 14 aa, Artificial Sequence
  Synthesized
  Modified Amino Acids (4)..(4): Xaa4 = norLeu = Norleucine, Nle
  Modified Amino Acids (12)..(12): Xaa12 = D-Ala = D-Alanine
CCEXCCNPACSXCY

SEQ ID NO: 2167 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCEXCCNPACXXCY

SEQ ID NO: 2168 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCEXCCNPACXXCY

SEQ ID NO: 2169 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCEXCCNPACXXCY

SEQ ID NO: 2170 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCEXCCNPACXXCY

SEQ ID NO: 2171 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCEXCCNPACXXCY

SEQ ID NO: 2172 - protein, 14 aa, Artificial Sequence
  Synthesized
  Modified Amino Acid (4)..(4): Xaa4 = norLeu = Norleucine, Nle
CCEXCCNPACTGCI

SEQ ID NO: 2173 - protein, 14 aa, Artificial Sequence
  Synthesized
  Modified Amino Acid (4)..(4): Xaa4 = norLeu = Norleucine, Nle
CCEXCCNPACSGCI

SEQ ID NO: 2174 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
CCEXCCNPACXGCI

SEQ ID NO: 2175 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
CCEXCCNPACXGCI

SEQ ID NO: 2176 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
CCEXCCNPACXGCI

SEQ ID NO: 2177 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
CCEXCCNPACXGCI

SEQ ID NO: 2178 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
CCEXCCNPACXGCI

SEQ ID NO: 2179 - protein, 14 aa, Artificial Sequence
  Synthesized
  Modified Amino Acid (4)..(4): Xaa4 = norLeu = Norleucine, Nle
CCEXCCNPACTGCW

SEQ ID NO: 2180 - protein, 14 aa, Artificial Sequence
  Synthesized
  Modified Amino Acid (4)..(4): Xaa4 = norLeu = Norleucine, Nle
CCEXCCNPACSGCW

SEQ ID NO: 2181 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4F-Phe = 4-fluoro-Phenylalanine, Phe(4-F), 4-fluorophenylalanine
CCEXCCNPACXGCW

SEQ ID NO: 2182 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeO-Phe = 4-methoxy-Phenylalanine, Phe(4-OMe), 4-methoxyphenylalanine
CCEXCCNPACXGCW

SEQ ID NO: 2183 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4NO2-Phe = 4-nitro-Phenylalanine, Phe(4-NO2), 4-Nitrophenylalanine
CCEXCCNPACXGCW

SEQ ID NO: 2184 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 5F-Phe = Pentafluoro-Phenylalanine, Phe(3-F), 3-fluorophenylalanine
CCEXCCNPACXGCW

SEQ ID NO: 2185 - protein, 14 aa, Artificial Sequence
  Synthesized
  Modified Amino Acids (4)..(4): Xaa4 = norLeu = Norleucine, Nle
  Modified Amino Acids (11)..(11): Xaa11 = 4MeF3-Phe = Phe(4-MeF3), 4-trifluoromethylphenylalanine
CCEXCCNPACXGCW

SEQ ID NO: 2186 - protein, 14 aa, Artificial Sequence
  Synthesized
  Modified Amino Acids (4)..(4): Xaa4 = ChxAla = Cyclohexyl-Aalanine, Cha
  Modified Amino Acids (12)..(12): Xaa12 = D-Ala = D-Alanine
CCEXCCNPACTXCY

SEQ ID NO: 2187 - protein, 14 aa, Artificial Sequence
  Synthesized
  Modified Amino Acids (4)..(4): Xaa4 = ChxAla = Cyclohexyl-Aalanine, Cha
  Modified Amino Acids (12)..(12): Xaa12 = D-Ala = D-Alanine
CCEXCCNPACSXCY

SEQ ID NO: 2188 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCEXCCNPACXXCY

SEQ ID NO: 2189 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCEXCCNPACXXCY

SEQ ID NO: 2190 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCEXCCNPACXXCY

SEQ ID NO: 2191 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCEXCCNPACXXCY

SEQ ID NO: 2192 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCEXCCNPACXXCY

SEQ ID NO: 2193 - protein, 14 aa, Artificial Sequence
  Synthesized
  Modified Amino Acid (4)..(4): Xaa4 = ChxAla = Cyclohexyl-Aalanine, Cha
CCEXCCNPACTGCI

SEQ ID NO: 2194 - protein, 14 aa, Artificial Sequence
  Synthesized
  Modified Amino Acid (4)..(4): Xaa4 = ChxAla = Cyclohexyl-Aalanine, Cha
CCEXCCNPACSGCI

SEQ ID NO: 2195 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
CCEXCCNPACXGCI

SEQ ID NO: 2196 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
CCEXCCNPACXGCI

SEQ ID NO: 2197 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
CCEXCCNPACXGCI

SEQ ID NO: 2198 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
CCEXCCNPACXGCI

SEQ ID NO: 2199 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
CCEXCCNPACXGCI

SEQ ID NO: 2200 - protein, 14 aa, Artificial Sequence
  Synthesized
  Modified Amino Acid (4)..(4): Xaa4 = ChxAla = Cyclohexyl-Aalanine, Cha
CCEXCCNPACTGCW

SEQ ID NO: 2201 - protein, 14 aa, Artificial Sequence
  Synthesized
  Modified Amino Acid (4)..(4): Xaa4 = ChxAla = Cyclohexyl-Aalanine, Cha
CCEXCCNPACSGCW

SEQ ID NO: 2202 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4F-Phe = 4-fluoro-Phenylalanine, Phe(4-F), 4-fluorophenylalanine
CCEXCCNPACXGCW

SEQ ID NO: 2203 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeO-Phe = 4-methoxy-Phenylalanine, Phe(4-OMe), 4-methoxyphenylalanine
CCEXCCNPACXGCW

SEQ ID NO: 2204 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4NO2-Phe = 4-nitro-Phenylalanine, Phe(4-NO2), 4-Nitrophenylalanine
CCEXCCNPACXGCW

SEQ ID NO: 2205 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 5F-Phe = Pentafluoro-Phenylalanine, Phe(3-F), 3-fluorophenylalanine
CCEXCCNPACXGCW

SEQ ID NO: 2206 - protein, 14 aa, Artificial Sequence
  Synthesized
  Modified Amino Acids (4)..(4): Xaa4 = ChxAla = Cyclohexyl-Aalanine, Cha
  Modified Amino Acids (11)..(11): Xaa11 = 4MeF3-Phe = Phe(4-MeF3), 4-trifluoromethylphenylalanine
CCEXCCNPACXGCW

SEQ ID NO: 2207 - protein, 14 aa, Artificial Sequence
  Synthesized
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCEXCCNPACTXCY

SEQ ID NO: 2208 - protein, 14 aa, Artificial Sequence
  Synthesized
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCEXCCNPACSXCY

SEQ ID NO: 2209 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCEXCCNPACXXCY

SEQ ID NO: 2210 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCEXCCNPACXXCY

SEQ ID NO: 2211 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCEXCCNPACXXCY

SEQ ID NO: 2212 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCEXCCNPACXXCY

SEQ ID NO: 2213 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCEXCCNPACXXCY

SEQ ID NO: 2214 - protein, 14 aa, Artificial Sequence
  Synthesized
  Modified Amino Acid (4)..(4): Xaa4 = ChxIle = Cyclohexyl-Isoleucine, Chi
CCEXCCNPACTGCI

SEQ ID NO: 2215 - protein, 14 aa, Artificial Sequence
  Synthesized
  Modified Amino Acid (4)..(4): Xaa4 = ChxIle = Cyclohexyl-Isoleucine, Chi
CCEXCCNPACSGCI

SEQ ID NO: 2216 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
CCEXCCNPACXGCI

SEQ ID NO: 2217 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
CCEXCCNPACXGCI

SEQ ID NO: 2218 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
CCEXCCNPACXGCI

SEQ ID NO: 2219 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
CCEXCCNPACXGCI

SEQ ID NO: 2220 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
CCEXCCNPACXGCI

SEQ ID NO: 2221 - protein, 14 aa, Artificial Sequence
  Synthesized
  Modified Amino Acid (4)..(4): Xaa4 = ChxIle = Cyclohexyl-Isoleucine, Chi
CCEXCCNPACTGCW

SEQ ID NO: 2222 - protein, 14 aa, Artificial Sequence
  Synthesized
  Modified Amino Acid (4)..(4): Xaa4 = ChxIle = Cyclohexyl-Isoleucine, Chi
CCEXCCNPACSGCW

SEQ ID NO: 2223 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4F-Phe = 4-fluoro-Phenylalanine, Phe(4-F), 4-fluorophenylalanine
CCEXCCNPACXGCW

SEQ ID NO: 2224 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeO-Phe = 4-methoxy-Phenylalanine, Phe(4-OMe), 4-methoxyphenylalanine
CCEXCCNPACXGCW

SEQ ID NO: 2225 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4NO2-Phe = 4-nitro-Phenylalanine, Phe(4-NO2), 4-Nitrophenylalanine
CCEXCCNPACXGCW

SEQ ID NO: 2226 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 5F-Phe = Pentafluoro-Phenylalanine, Phe(3-F), 3-fluorophenylalanine
CCEXCCNPACXGCW

SEQ ID NO: 2227 - protein, 14 aa, Artificial Sequence
  Synthesized
  Modified Amino Acids (4)..(4): Xaa4 = ChxIle = Cyclohexyl-Isoleucine, Chi
  Modified Amino Acids (11)..(11): Xaa11 = 4MeF3-Phe = Phe(4-MeF3), 4-trifluoromethylphenylalanine
CCEXCCNPACXGCW

SEQ ID NO: 2228 - protein, 14 aa, Artificial Sequence
  Synthesized
  Modified Amino Acid (12)..(12): Xaa12 = D-Ala = D-Alanine
CCEFCCNPACTXCY

SEQ ID NO: 2229 - protein, 14 aa, Artificial Sequence
  Synthesized
  Modified Amino Acid (12)..(12): Xaa12 = D-Ala = D-Alanine
CCEFCCNPACSXCY

SEQ ID NO: 2230 - protein, 14 aa, Artificial Sequence
  Synthesized
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCEFCCNPACXXCY

SEQ ID NO: 2231 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCEFCCNPACXXCY

SEQ ID NO: 2232 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCEFCCNPACXXCY

SEQ ID NO: 2233 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCEFCCNPACXXCY

SEQ ID NO: 2234 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCEFCCNPACXXCY

SEQ ID NO: 2235 - protein, 14 aa, Artificial Sequence
  Synthesized
CCEFCCNPACTGCI

SEQ ID NO: 2236 - protein, 14 aa, Artificial Sequence
  Synthesized
CCEFCCNPACSGCI

SEQ ID NO: 2237 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEFCCNPACXGCI

SEQ ID NO: 2238 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEFCCNPACXGCI

SEQ ID NO: 2239 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEFCCNPACXGCI

SEQ ID NO: 2240 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEFCCNPACXGCI

SEQ ID NO: 2241 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEFCCNPACXGCI

SEQ ID NO: 2242 - protein, 14 aa, Artificial Sequence
  Synthesized
CCEFCCNPACTGCW

SEQ ID NO: 2243 - protein, 14 aa, Artificial Sequence
  Synthesized
CCEFCCNPACSGCW

SEQ ID NO: 2244 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEFCCNPACXGCW

SEQ ID NO: 2245 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEFCCNPACXGCW

SEQ ID NO: 2246 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEFCCNPACXGCW

SEQ ID NO: 2247 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEFCCNPACXGCW

SEQ ID NO: 2248 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEFCCNPACXGCW

SEQ ID NO: 2249 - protein, 14 aa, Artificial Sequence
  Synthesized
  Modified Amino Acid (12)..(12): Xaa12 = D-Ala = D-Alanine
CCEYCCNPACTXCY

SEQ ID NO: 2250 - protein, 14 aa, Artificial Sequence
  Synthesized
  Modified Amino Acid (12)..(12): Xaa12 = D-Ala = D-Alanine
CCEYCCNPACSXCY

SEQ ID NO: 2251 - protein, 14 aa, Artificial Sequence
  Synthesized
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCEYCCNPACXXCY

SEQ ID NO: 2252 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCEYCCNPACXXCY

SEQ ID NO: 2253 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCEYCCNPACXXCY

SEQ ID NO: 2254 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCEYCCNPACXXCY

SEQ ID NO: 2255 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCEYCCNPACXXCY

SEQ ID NO: 2256 - protein, 14 aa, Artificial Sequence
  Synthesized
CCEYCCNPACTGCI

SEQ ID NO: 2257 - protein, 14 aa, Artificial Sequence
  Synthesized
CCEYCCNPACSGCI

SEQ ID NO: 2258 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEYCCNPACXGCI

SEQ ID NO: 2259 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEYCCNPACXGCI

SEQ ID NO: 2260 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEYCCNPACXGCI

SEQ ID NO: 2261 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEYCCNPACXGCI

SEQ ID NO: 2262 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEYCCNPACXGCI

SEQ ID NO: 2263 - protein, 14 aa, Artificial Sequence
  Synthesized
CCEYCCNPACTGCW

SEQ ID NO: 2264 - protein, 14 aa, Artificial Sequence
  Synthesized
CCEYCCNPACSGCW

SEQ ID NO: 2265 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCEYCCNPACXGCW

SEQ ID NO: 2266 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCEYCCNPACXGCW

SEQ ID NO: 2267 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCEYCCNPACXGCW

SEQ ID NO: 2268 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCEYCCNPACXGCW

SEQ ID NO: 2269 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCEYCCNPACXGCW

SEQ ID NO: 2270 - protein, 14 aa, Artificial Sequence
  Synthesized
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCEXCCNPACTXCY

SEQ ID NO: 2271 - protein, 14 aa, Artificial Sequence
  Synthesized
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCEXCCNPACSXCY

SEQ ID NO: 2272 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCEXCCNPACXXCY

SEQ ID NO: 2273 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCEXCCNPACXXCY

SEQ ID NO: 2274 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCEXCCNPACXXCY

SEQ ID NO: 2275 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCEXCCNPACXXCY

SEQ ID NO: 2276 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCEXCCNPACXXCY

SEQ ID NO: 2277 - protein, 14 aa, Artificial Sequence
  Synthesized
  Modified Amino Acid (4)..(4): Xaa4 = Dopa = L-Dopa, L-dihydroxyphenylalanine
CCEXCCNPACTGCI

SEQ ID NO: 2278 - protein, 14 aa, Artificial Sequence
  Synthesized
  Modified Amino Acid (4)..(4): Xaa4 = Dopa = L-Dopa, L-dihydroxyphenylalanine
CCEXCCNPACSGCI

SEQ ID NO: 2279 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
CCEXCCNPACXGCI

SEQ ID NO: 2280 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
CCEXCCNPACXGCI

SEQ ID NO: 2281 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
CCEXCCNPACXGCI

SEQ ID NO: 2282 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
CCEXCCNPACXGCI

SEQ ID NO: 2283 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
CCEXCCNPACXGCI

SEQ ID NO: 2284 - protein, 14 aa, Artificial Sequence
  Synthesized
  Modified Amino Acid (4)..(4): Xaa4 = Dopa = L-Dopa, L-dihydroxyphenylalanine
CCEXCCNPACTGCW

SEQ ID NO: 2285 - protein, 14 aa, Artificial Sequence
  Synthesized
  Modified Amino Acid (4)..(4): Xaa4 = Dopa = L-Dopa, L-dihydroxyphenylalanine
CCEXCCNPACSGCW

SEQ ID NO: 2286 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4F-Phe = 4-fluoro-Phenylalanine, Phe(4-F), 4-fluorophenylalanine
CCEXCCNPACXGCW

SEQ ID NO: 2287 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeO-Phe = 4-methoxy-Phenylalanine, Phe(4-OMe), 4-methoxyphenylalanine
CCEXCCNPACXGCW

SEQ ID NO: 2288 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4NO2-Phe = 4-nitro-Phenylalanine, Phe(4-NO2), 4-Nitrophenylalanine
CCEXCCNPACXGCW

SEQ ID NO: 2289 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 5F-Phe = Pentafluoro-Phenylalanine, Phe(3-F), 3-fluorophenylalanine
CCEXCCNPACXGCW

SEQ ID NO: 2290 - protein, 14 aa, Artificial Sequence
  Synthesized
  Modified Amino Acids (4)..(4): Xaa4 = Dopa = L-Dopa, L-dihydroxyphenylalanine
  Modified Amino Acids (11)..(11): Xaa11 = 4MeF3-Phe = Phe(4-MeF3), 4-trifluoromethylphenylalanine
CCEXCCNPACXGCW

SEQ ID NO: 2291 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCEXCCNPACTXCY

SEQ ID NO: 2292 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCEXCCNPACSXCY

SEQ ID NO: 2293 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCEXCCNPACXXCY

SEQ ID NO: 2294 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCEXCCNPACXXCY

SEQ ID NO: 2295 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCEXCCNPACXXCY

SEQ ID NO: 2296 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCEXCCNPACXXCY

SEQ ID NO: 2297 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCEXCCNPACXXCY

SEQ ID NO: 2298 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACTGCI

SEQ ID NO: 2299 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACSGCI

SEQ ID NO: 2300 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
CCEXCCNPACXGCI

SEQ ID NO: 2301 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
CCEXCCNPACXGCI

SEQ ID NO: 2302 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
CCEXCCNPACXGCI

SEQ ID NO: 2303 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
CCEXCCNPACXGCI

SEQ ID NO: 2304 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
CCEXCCNPACXGCI

SEQ ID NO: 2305 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACTGCW

SEQ ID NO: 2306 - protein, 14 aa, Artificial Sequence
  Synthesized
  Modified Amino Acid (4)..(4): Xaa4 = NMe-Leu = N-methyl-leucine, MeLeu, N-Methylleucine
CCEXCCNPACSGCW

SEQ ID NO: 2307 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4F-Phe = 4-fluoro-Phenylalanine, Phe(4-F), 4-fluorophenylalanine
CCEXCCNPACXGCW

SEQ ID NO: 2308 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeO-Phe = 4-methoxy-Phenylalanine, Phe(4-OMe), 4-methoxyphenylalanine
CCEXCCNPACXGCW

SEQ ID NO: 2309 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4NO2-Phe = 4-nitro-Phenylalanine, Phe(4-NO2), 4-Nitrophenylalanine
CCEXCCNPACXGCW

SEQ ID NO: 2310 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 5F-Phe = Pentafluoro-Phenylalanine, Phe(3-F), 3-fluorophenylalanine
CCEXCCNPACXGCW

SEQ ID NO: 2311 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (11)..(11): Xaa11 = 4MeF3-Phe = Phe(4-MeF3), 4-trifluoromethylphenylalanine
CCEXCCNPACXGCW

SEQ ID NO: 2312 - protein, 14 aa, Artificial Sequence
  Synthesized
  Modified Amino Acid (12)..(12): Xaa12 = D-Ala = D-Alanine
CCETCCNPACAXCI

SEQ ID NO: 2313 - protein, 14 aa, Artificial Sequence
  Synthesized
  Modified Amino Acid (12)..(12): Xaa12 = D-Ala = D-Alanine
CCETCCNPACAXCW

SEQ ID NO: 2314 - protein, 14 aa, Artificial Sequence
  Synthesized
  Modified Amino Acids (4)..(4): Xaa4 = hLeu = Homoleucine, Hle
  Modified Amino Acids (12)..(12): Xaa12 = D-Ala = D-Alanine
CCEXCCNPACAXCI

SEQ ID NO: 2315 - protein, 14 aa, Artificial Sequence
  Synthesized
  Modified Amino Acids (4)..(4): Xaa4 = hLeu = Homoleucine, Hle
  Modified Amino Acids (12)..(12): Xaa12 = D-Ala = D-Alanine
CCEXCCNPACAXCW

SEQ ID NO: 2316 - protein, 14 aa, Artificial Sequence
  Synthesized
  Modified Amino Acids (4)..(4): Xaa4 = norLeu = Norleucine, Nle
  Modified Amino Acids (12)..(12): Xaa12 = D-Ala = D-Alanine
CCEXCCNPACAXCI

SEQ ID NO: 2317 - protein, 14 aa, Artificial Sequence
  Synthesized
  Modified Amino Acids (4)..(4): Xaa4 = norLeu = Norleucine, Nle
  Modified Amino Acids (12)..(12): Xaa12 = D-Ala = D-Alanine
CCEXCCNPACAXCW

SEQ ID NO: 2318 - protein, 14 aa, Artificial Sequence
  Synthesized
  Modified Amino Acids (4)..(4): Xaa4 = ChxAla = Cyclohexyl-Aalanine, Cha
  Modified Amino Acids (12)..(12): Xaa12 = D-Ala = D-Alanine
CCEXCCNPACAXCI

SEQ ID NO: 2319 - protein, 14 aa, Artificial Sequence
  Synthesized
  Modified Amino Acids (4)..(4): Xaa4 = ChxAla = Cyclohexyl-Aalanine, Cha
  Modified Amino Acids (12)..(12): Xaa12 = D-Ala = D-Alanine
CCEXCCNPACAXCW

SEQ ID NO: 2320 - protein, 14 aa, Artificial Sequence
  Synthesized
  Modified Amino Acids (4)..(4): Xaa4 = ChxIle = Cyclohexyl-Isoleucine, Chi
  Modified Amino Acids (12)..(12): Xaa12 = D-Ala = D-Alanine
CCEXCCNPACAXCI

SEQ ID NO: 2321 - protein, 14 aa, Artificial Sequence
  Synthesized
  Modified Amino Acids (4)..(4): Xaa4 = ChxIle = Cyclohexyl-Isoleucine, Chi
  Modified Amino Acids (12)..(12): Xaa4 = ChxIle = Cyclohexyl-Isoleucine, Chi
CCEXCCNPACAXCW

SEQ ID NO: 2322 - protein, 14 aa, Artificial Sequence
  Synthesized
  Modified Amino Acid (12)..(12): Xaa12 = D-Ala = D-Alanine
CCEFCCNPACAXCI

SEQ ID NO: 2323 - protein, 14 aa, Artificial Sequence
  Synthesized
  Modified Amino Acid (12)..(12): Xaa12 = D-Ala = D-Alanine
CCEFCCNPACAXCW

SEQ ID NO: 2324 - protein, 14 aa, Artificial Sequence
  Synthesized
  Modified Amino Acid (12)..(12): Xaa12 = D-Ala = D-Alanine
CCEYCCNPACAXCI

SEQ ID NO: 2325 - protein, 14 aa, Artificial Sequence
  Synthesized
  Modified Amino Acid (12)..(12): Xaa12 = D-Ala = D-Alanine
CCEYCCNPACAXCW

SEQ ID NO: 2326 - protein, 14 aa, Artificial Sequence
  Synthesized
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCEXCCNPACAXCI

SEQ ID NO: 2327 - protein, 14 aa, Artificial Sequence
  Synthesized
  Modified Amino Acids (4)..(4): Xaa4 = Dopa = L-Dopa, L-dihydroxyphenylalanine
  Modified Amino Acids (12)..(12): Xaa12 = D-Ala = D-Alanine
CCEXCCNPACAXCW

SEQ ID NO: 2328 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCEXCCNPACAXCI

SEQ ID NO: 2329 - protein, 14 aa, Artificial Sequence
  Synthesized
  Modified Amino Acids (4)..(4): Xaa4 = NMe-Leu = N-methyl-leucine, MeLeu, N-Methylleucine
  Modified Amino Acids (12)..(12): Xaa12 = D-Ala = D-Alanine
CCEXCCNPACAXCW

SEQ ID NO: 2330 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCELCCNXACTXCY

SEQ ID NO: 2331 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCELCCNXACSXCY

SEQ ID NO: 2332 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNXACXXCY

SEQ ID NO: 2333 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNXACXXCY

SEQ ID NO: 2334 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCELCCNXACXXCY

SEQ ID NO: 2335 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNXACXXCY

SEQ ID NO: 2336 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCELCCNXACXXCY

SEQ ID NO: 2337 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACTGCI

SEQ ID NO: 2338 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACSGCI

SEQ ID NO: 2339 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCELCCNXACXGCI

SEQ ID NO: 2340 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCELCCNXACXGCI

SEQ ID NO: 2341 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCELCCNXACXGCI

SEQ ID NO: 2342 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCELCCNXACXGCI

SEQ ID NO: 2343 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCELCCNXACXGCI

SEQ ID NO: 2344 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACTGCW

SEQ ID NO: 2345 - protein, 14 aa, Artificial Sequence
  Synthesized
  Modified Amino Acid (8)..(8): Xaa8 = Dhp = 3,4,-dihydro-Proline, D-Pro 3,4-Dehydroproline
CCELCCNXACSGCW

SEQ ID NO: 2346 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4F-Phe = 4-fluoro-Phenylalanine, Phe(4-F), 4-fluorophenylalanine
CCELCCNXACXGCW

SEQ ID NO: 2347 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeO-Phe = 4-methoxy-Phenylalanine, Phe(4-OMe), 4-methoxyphenylalanine
CCELCCNXACXGCW

SEQ ID NO: 2348 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4NO2-Phe = 4-nitro-Phenylalanine, Phe(4-NO2), 4-Nitrophenylalanine
CCELCCNXACXGCW

SEQ ID NO: 2349 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 5F-Phe = Pentafluoro-Phenylalanine, Phe(3-F), 3-fluorophenylalanine
CCELCCNXACXGCW

SEQ ID NO: 2350 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (11)..(11): Xaa11 = 4MeF3-Phe = Phe(4-MeF3), 4-trifluoromethylphenylalanine
CCELCCNXACXGCW

SEQ ID NO: 2351 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCELCCNXACTXCY

SEQ ID NO: 2352 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCELCCNXACSXCY

SEQ ID NO: 2353 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNXACXXCY

SEQ ID NO: 2354 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNXACXXCY

SEQ ID NO: 2355 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCELCCNXACXXCY

SEQ ID NO: 2356 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNXACXXCY

SEQ ID NO: 2357 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCELCCNXACXXCY

SEQ ID NO: 2358 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACTGCI

SEQ ID NO: 2359 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACSGCI

SEQ ID NO: 2360 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCELCCNXACXGCI

SEQ ID NO: 2361 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCELCCNXACXGCI

SEQ ID NO: 2362 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCELCCNXACXGCI

SEQ ID NO: 2363 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCELCCNXACXGCI

SEQ ID NO: 2364 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCELCCNXACXGCI

SEQ ID NO: 2365 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACTGCW

SEQ ID NO: 2366 - protein, 14 aa, Artificial Sequence
  Synthesized
  Modified Amino Acid (8)..(8): Xaa8 = Thz = Thiazolidine (4-thiazolidine-2-carboxylic acid), Tzd
CCELCCNXACSGCW

SEQ ID NO: 2367 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4F-Phe = 4-fluoro-Phenylalanine, Phe(4-F), 4-fluorophenylalanine
CCELCCNXACXGCW

SEQ ID NO: 2368 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeO-Phe = 4-methoxy-Phenylalanine, Phe(4-OMe), 4-methoxyphenylalanine
CCELCCNXACXGCW

SEQ ID NO: 2369 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4NO2-Phe = 4-nitro-Phenylalanine, Phe(4-NO2), 4-Nitrophenylalanine
CCELCCNXACXGCW

SEQ ID NO: 2370 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 5F-Phe = Pentafluoro-Phenylalanine, Phe(3-F), 3-fluorophenylalanine
CCELCCNXACXGCW

SEQ ID NO: 2371 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (11)..(11): Xaa11 = 4MeF3-Phe = Phe(4-MeF3), 4-trifluoromethylphenylalanine
CCELCCNXACXGCW

SEQ ID NO: 2372 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCELCCNXACTXCY

SEQ ID NO: 2373 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCELCCNXACSXCY

SEQ ID NO: 2374 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNXACXXCY

SEQ ID NO: 2375 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNXACXXCY

SEQ ID NO: 2376 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa11 = 4NO2-Phe = 4-nitro-Phenylalanine, Phe(4-NO2), 4-Nitrophenylalanine Xaa12 = D-Ala = D-Alanine
CCELCCNXACXXCY

SEQ ID NO: 2377 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNXACXXCY

SEQ ID NO: 2378 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
  Modified Amino Acids (12)..(12): Xaa11 = 4MeF3-Phe = Phe(4-MeF3), 4-trifluoromethylphenylalanine Xaa12 = D-Ala = D-Alanine
CCELCCNXACXXCY

SEQ ID NO: 2379 - protein, 14 aa, Artificial Sequence
  Synthesized
  Modified Amino Acid (8)..(8): Xaa8 = HyPro = Hydroxy-Proline, Hyp, Hydroxyproline
CCELCCNXACTGCI

SEQ ID NO: 2380 - protein, 14 aa, Artificial Sequence
  Synthesized
  Modified Amino Acid (8)..(8): Xaa8 = HyPro = Hydroxy-Proline, Hyp, Hydroxyproline
CCELCCNXACSGCI

SEQ ID NO: 2381 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCELCCNXACXGCI

SEQ ID NO: 2382 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCELCCNXACXGCI

SEQ ID NO: 2383 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCELCCNXACXGCI

SEQ ID NO: 2384 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCELCCNXACXGCI

SEQ ID NO: 2385 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCELCCNXACXGCI

SEQ ID NO: 2386 - protein, 14 aa, Artificial Sequence
  Synthesized
  Modified Amino Acid (8)..(8): Xaa8 = HyPro = Hydroxy-Proline, Hyp, Hydroxyproline
CCELCCNXACTGCW

SEQ ID NO: 2387 - protein, 14 aa, Artificial Sequence
  Synthesized
  Modified Amino Acid (8)..(8): Xaa8 = HyPro = Hydroxy-Proline, Hyp, Hydroxyproline
CCELCCNXACSGCW

SEQ ID NO: 2388 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4F-Phe = 4-fluoro-Phenylalanine, Phe(4-F), 4-fluorophenylalanine
CCELCCNXACXGCW

SEQ ID NO: 2389 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeO-Phe = 4-methoxy-Phenylalanine, Phe(4-OMe), 4-methoxyphenylalanine
CCELCCNXACXGCW

SEQ ID NO: 2390 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4NO2-Phe = 4-nitro-Phenylalanine, Phe(4-NO2), 4-Nitrophenylalanine
CCELCCNXACXGCW

SEQ ID NO: 2391 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 5F-Phe = Pentafluoro-Phenylalanine, Phe(3-F), 3-fluorophenylalanine
CCELCCNXACXGCW

SEQ ID NO: 2392 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (11)..(11): Xaa11 = 4MeF3-Phe = Phe(4-MeF3), 4-trifluoromethylphenylalanine
CCELCCNXACXGCW

SEQ ID NO: 2393 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCELCCNXACTXCY

SEQ ID NO: 2394 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCELCCNXACSXCY

SEQ ID NO: 2395 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNXACXXCY

SEQ ID NO: 2396 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNXACXXCY

SEQ ID NO: 2397 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCELCCNXACXXCY

SEQ ID NO: 2398 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNXACXXCY

SEQ ID NO: 2399 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCELCCNXACXXCY

SEQ ID NO: 2400 - protein, 14 aa, Artificial Sequence
  Synthesized
  Modified Amino Acid (8)..(8): Xaa8 = Pip = L-Pipecolic Acid
CCELCCNXACTGCI

SEQ ID NO: 2401 - protein, 14 aa, Artificial Sequence
  Synthesized
  Modified Amino Acid (8)..(8): Xaa8 = Pip = L-Pipecolic Acid
CCELCCNXACSGCI

SEQ ID NO: 2402 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCELCCNXACXGCI

SEQ ID NO: 2403 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCELCCNXACXGCI

SEQ ID NO: 2404 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-Nitrophenylalanine
CCELCCNXACXGCI

SEQ ID NO: 2405 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCELCCNXACXGCI

SEQ ID NO: 2406 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCELCCNXACXGCI

SEQ ID NO: 2407 - protein, 14 aa, Artificial Sequence
  Synthesized
  Modified Amino Acid (8)..(8): Xaa8 = Pip = L-Pipecolic Acid
CCELCCNXACTGCW

SEQ ID NO: 2408 - protein, 14 aa, Artificial Sequence
  Synthesized
  Modified Amino Acid (8)..(8): Xaa8 = Pip = L-Pipecolic Acid
CCELCCNXACSGCW

SEQ ID NO: 2409 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4F-Phe = 4-fluoro-Phenylalanine, Phe(4-F), 4-fluorophenylalanine
CCELCCNXACXGCW

SEQ ID NO: 2410 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeO-Phe = 4-methoxy-Phenylalanine, Phe(4-OMe), 4-methoxyphenylalanine
CCELCCNXACXGCW

SEQ ID NO: 2411 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4NO2-Phe = 4-nitro-Phenylalanine, Phe(4-NO2), 4-NitrophenylalanineAcid
CCELCCNXACXGCW

SEQ ID NO: 2412 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 5F-Phe = Pentafluoro-Phenylalanine, Phe(3-F), 3-fluorophenylalanine
CCELCCNXACXGCW

SEQ ID NO: 2413 - protein, 14 aa, Artificial Sequence
  Synthesized
  Modified Amino Acids (8)..(8): Xaa8 = Pip = L-Pipecolic Acid
  Modified Amino Acids (11)..(11): Xaa11 = 4MeF3-Phe = Phe(4-MeF3), 4-trifluoromethylphenylalanine
CCELCCNXACXGCW

SEQ ID NO: 2414 - protein, 14 aa, Artificial Sequence
  Synthesized
  Modified Amino Acid (12)..(12): Xaa12 = D-Ala = D-Alanine
CCELCCNIACTXCY

SEQ ID NO: 2415 - protein, 14 aa, Artificial Sequence
  Synthesized
  Modified Amino Acid (12)..(12): Xaa12 = D-Ala = D-Alanine
CCELCCNIACSXCY

SEQ ID NO: 2416 - protein, 14 aa, Artificial Sequence
  Synthesized
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNIACXXCY

SEQ ID NO: 2417 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNIACXXCY

SEQ ID NO: 2418 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCELCCNIACXXCY

SEQ ID NO: 2419 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNIACXXCY

SEQ ID NO: 2420 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCELCCNIACXXCY

SEQ ID NO: 2421 - protein, 14 aa, Artificial Sequence
  Synthesized
CCELCCNIACTGCI

SEQ ID NO: 2422 - protein, 14 aa, Artificial Sequence
  Synthesized
CCELCCNIACSGCI

SEQ ID NO: 2423 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNIACXGCI

SEQ ID NO: 2424 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNIACXGCI

SEQ ID NO: 2425 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNIACXGCI

SEQ ID NO: 2426 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNIACXGCI

SEQ ID NO: 2427 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNIACXGCI

SEQ ID NO: 2428 - protein, 14 aa, Artificial Sequence
  Synthesized
CCELCCNIACTGCW

SEQ ID NO: 2429 - protein, 14 aa, Artificial Sequence
  Synthesized
CCELCCNIACSGCW

SEQ ID NO: 2430 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNIACXGCW

SEQ ID NO: 2431 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNIACXGCW

SEQ ID NO: 2432 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNIACXGCW

SEQ ID NO: 2433 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNIACXGCW

SEQ ID NO: 2434 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNIACXGCW

SEQ ID NO: 2435 - protein, 14 aa, Artificial Sequence
  Synthesized
  Modified Amino Acid (12)..(12): Xaa12 = D-Ala = D-Alanine
CCELCCNAACTXCY

SEQ ID NO: 2436 - protein, 14 aa, Artificial Sequence
  Synthesized
  Modified Amino Acid (12)..(12): Xaa12 = D-Ala = D-Alanine
CCELCCNAACSXCY

SEQ ID NO: 2437 - protein, 14 aa, Artificial Sequence
  Synthesized
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNAACXXCY

SEQ ID NO: 2438 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNAACXXCY

SEQ ID NO: 2439 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCELCCNAACXXCY

SEQ ID NO: 2440 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNAACXXCY

SEQ ID NO: 2441 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCELCCNAACXXCY

SEQ ID NO: 2442 - protein, 14 aa, Artificial Sequence
  Synthesized
CCELCCNAACTGCI

SEQ ID NO: 2443 - protein, 14 aa, Artificial Sequence
  Synthesized
CCELCCNAACSGCI

SEQ ID NO: 2444 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNAACXGCI

SEQ ID NO: 2445 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNAACXGCI

SEQ ID NO: 2446 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNAACXGCI

SEQ ID NO: 2447 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNAACXGCI

SEQ ID NO: 2448 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNAACXGCI

SEQ ID NO: 2449 - protein, 14 aa, Artificial Sequence
  Synthesized
CCELCCNAACTGCW

SEQ ID NO: 2450 - protein, 14 aa, Artificial Sequence
  Synthesized
CCELCCNAACSGCW

SEQ ID NO: 2451 - protein, 14 aa, Artificial Sequence
  Synthesized
  Modified Amino Acid (11)..(11): Xaa11 = 4F-Phe = 4-fluoro-Phenylalanine, Phe(4-F), 4-fluorophenylalanine
CCELCCNAACXGCW

SEQ ID NO: 2452 - protein, 14 aa, Artificial Sequence
  Synthesized
  Modified Amino Acid (11)..(11): Xaa11 = 4MeO-Phe = 4-methoxy-Phenylalanine, Phe(4-OMe), 4-methoxyphenylalanine
CCELCCNAACXGCW

SEQ ID NO: 2453 - protein, 14 aa, Artificial Sequence
  Synthesized
  Modified Amino Acid (11)..(11): Xaa11 = 4NO2-Phe = 4-nitro-Phenylalanine, Phe(4-NO2), 4-Nitrophenylalanine
CCELCCNAACXGCW

SEQ ID NO: 2454 - protein, 14 aa, Artificial Sequence
  Synthesized
  Modified Amino Acid (11)..(11): Xaa11 = 5F-Phe = Pentafluoro-Phenylalanine, Phe(3-F), 3-fluorophenylalanine
CCELCCNAACXGCW

SEQ ID NO: 2455 - protein, 14 aa, Artificial Sequence
  Synthesized
  Modified Amino Acid (11)..(11): Xaa11 = 4MeF3-Phe = Phe(4-MeF3), 4-trifluoromethylphenylalanine
CCELCCNAACXGCW

SEQ ID NO: 2456 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCELCCNXACAXCI

SEQ ID NO: 2457 - protein, 14 aa, Artificial Sequence
  Synthesized
  Modified Amino Acids (8)..(8): Xaa8 = Dhp = 3,4,-dihydro-Proline, D-Pro 3,4-Dehydroproline
  Modified Amino Acids (12)..(12): Xaa12 = D-Ala = D-Alanine
CCELCCNXACAXCW

SEQ ID NO: 2458 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCELCCNXACAXCI

SEQ ID NO: 2459 - protein, 14 aa, Artificial Sequence
  Synthesized
  Modified Amino Acids (8)..(8): Xaa8 = Thz = Thiazolidine (4-thiazolidine-2-carboxylic acid), Tzd
  Modified Amino Acids (12)..(12): Xaa12 = D-Ala = D-Alanine
CCELCCNXACAXCW

SEQ ID NO: 2460 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCELCCNXACAXCI

SEQ ID NO: 2461 - protein, 14 aa, Artificial Sequence
  Synthesized
  Modified Amino Acids (8)..(8): Xaa8 = HyPro = Hydroxy-Proline, Hyp, Hydroxyproline
  Modified Amino Acids (12)..(12): Xaa12 = D-Ala = D-Alanine
CCELCCNXACAXCW

SEQ ID NO: 2462 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCELCCNXACAXCI

SEQ ID NO: 2463 - protein, 14 aa, Artificial Sequence
  Synthesized
  Modified Amino Acids (8)..(8): Xaa8 = Pip = L-Pipecolic Acid
  Modified Amino Acids (12)..(12): Xaa12 = D-Ala = D-Alanine
CCELCCNXACAXCW

SEQ ID NO: 2464 - protein, 14 aa, Artificial Sequence
  Synthesized
  Modified Amino Acid (12)..(12): Xaa12 = D-Ala = D-Alanine
CCELCCNIACAXCI

SEQ ID NO: 2465 - protein, 14 aa, Artificial Sequence
  Synthesized
  Modified Amino Acid (12)..(12): Xaa12 = D-Ala = D-Alanine
CCELCCNIACAXCW

SEQ ID NO: 2466 - protein, 14 aa, Artificial Sequence
  Synthesized
  Modified Amino Acid (12)..(12): Xaa12 = D-Ala = D-Alanine
CCELCCNAACAXCI

SEQ ID NO: 2467 - protein, 14 aa, Artificial Sequence
  Synthesized
  Modified Amino Acid (12)..(12): Xaa12 = D-Ala = D-Alanine
CCELCCNAACAXCW

SEQ ID NO: 2468 - protein, 14 aa, Artificial Sequence
  Synthesized
  Modified Amino Acid (12)..(12): Xaa12 = D-Ala = D-Alanine
CCELCCNPACTXCI

SEQ ID NO: 2469 - protein, 14 aa, Artificial Sequence
  Synthesized
  Modified Amino Acid (12)..(12): Xaa12 = D-Ala = D-Alanine
CCELCCNPACTXCW

SEQ ID NO: 2470 - protein, 14 aa, Artificial Sequence
  Synthesized
  Modified Amino Acid (12)..(12): Xaa12 = D-Ala = D-Alanine
CCELCCNPACSXCI

SEQ ID NO: 2471 - protein, 14 aa, Artificial Sequence
  Synthesized
  Modified Amino Acid (12)..(12): Xaa12 = D-Ala = D-Alanine
CCELCCNPACSXCW

SEQ ID NO: 2472 - protein, 14 aa, Artificial Sequence
  Synthesized
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNPACXXCI

SEQ ID NO: 2473 - protein, 14 aa, Artificial Sequence
  Synthesized
  Modified Amino Acids (11)..(11): Xaa11 = 4F-Phe = 4-fluoro-Phenylalanine, Phe(4-F), 4-fluorophenylalanine
  Modified Amino Acids (12)..(12): Xaa12 = D-Ala = D-Alanine
CCELCCNPACXXCW

SEQ ID NO: 2474 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNPACXXCI

SEQ ID NO: 2475 - protein, 14 aa, Artificial Sequence
  Synthesized
  Modified Amino Acids (11)..(11): Xaa11 = 4MeO-Phe = 4-methoxy-Phenylalanine, Phe(4-OMe), 4-methoxyphenylalanine
  Modified Amino Acids (12)..(12): Xaa12 = D-Ala = D-Alanine
CCELCCNPACXXCW

SEQ ID NO: 2476 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCELCCNPACXXCI

SEQ ID NO: 2477 - protein, 14 aa, Artificial Sequence
  Synthesized
  Modified Amino Acids (11)..(11): Xaa11 = 4NO2-Phe = 4-nitro-Phenylalanine, Phe(4-NO2), 4-Nitrophenylalanine
  Modified Amino Acids (12)..(12): Xaa12 = D-Ala = D-Alanine
CCELCCNPACXXCW

SEQ ID NO: 2478 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNPACXXCI

SEQ ID NO: 2479 - protein, 14 aa, Artificial Sequence
  Synthesized
  Modified Amino Acids (11)..(11): Xaa11 = 5F-Phe = Pentafluoro-Phenylalanine, Phe(3-F), 3-fluorophenylalanine
  Modified Amino Acids (12)..(12): Xaa12 = D-Ala = D-Alanine
CCELCCNPACXXCW

SEQ ID NO: 2480 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa11 = 4MeF3-Phe = Phe(4-MeF3), 4-trifluoromethylphenylalanine
CCELCCNPACXXCI

SEQ ID NO: 2481 - protein, 14 aa, Artificial Sequence
  Synthesized
  Modified Amino Acids (11)..(11): Xaa11 = 4MeF3-Phe = Phe(4-MeF3), 4-trifluoromethylphenylalanine
  Modified Amino Acids (12)..(12): Xaa12 = D-Ala = D-Alanine
CCELCCNPACXXCW

SEQ ID NO: 2482-2499 - skipped (18 entries)

SEQ ID NO: 2500 - protein, 14 aa, Artificial Sequence
  Synthesized
  Modified Amino Acid (4)..(4): Xaa4 = THa = (S)-2-amino-3-hydroxypropanoic acid
CCEXCCNPACAGCY

SEQ ID NO: 2501 - protein, 14 aa, Artificial Sequence
  Synthesized
  Modified Amino Acid (4)..(4): Xaa4 = THb = (R)-2-amino-3-(methylsulfonyl)propanoic acid
CCEXCCNPACAGCY

SEQ ID NO: 2502 - protein, 14 aa, Artificial Sequence
  Synthesized
  Modified Amino Acid (4)..(4): Xaa4 = THc = (S)-2-amino-3-(2-hydroxyphenyl)propanoic acid
CCEXCCNPACAGCY

SEQ ID NO: 2503 - protein, 14 aa, Artificial Sequence
  Synthesized
  Modified Amino Acid (4)..(4): Xaa4 = THd = (S)-2-aminopent-4-enoic acid
CCEXCCNPACAGCY

SEQ ID NO: 2504 - protein, 14 aa, Artificial Sequence
  Synthesized
  Modified Amino Acid (4)..(4): Xaa4 = THe = (S)-2-amino-2-((R)-oxiran-2-yl)acetic acid
CCEXCCNPACAGCY

SEQ ID NO: 2505 - protein, 14 aa, Artificial Sequence
  Synthesized
  Modified Amino Acid (4)..(4): Xaa4 = THf = (S)-2-amino-2-(furan-2-yl)acetic acid
CCEXCCNPACAGCY

SEQ ID NO: 2506 - protein, 14 aa, Artificial Sequence
  Synthesized
  Modified Amino Acid (4)..(4): Xaa4 = THg = (S)-2-amino-2-((S)-morpholin-2-yl)acetic acid
CCEXCCNPACAGCY

SEQ ID NO: 2507 - protein, 14 aa, Artificial Sequence
  Synthesized
  Modified Amino Acid (4)..(4): Xaa4 = THh = (S)-2-amino-3-(dimethylamino)propanoic acid
CCEXCCNPACAGCY

SEQ ID NO: 2508 - protein, 14 aa, Artificial Sequence
  Synthesized
  Modified Amino Acid (4)..(4): Xaa4 = THi = (2R,3R)-2-amino-3-hydroxybutanoic acid
CCEXCCNPACAGCY

SEQ ID NO: 2509 - protein, 14 aa, Artificial Sequence
  Synthesized
  Modified Amino Acid (4)..(4): Xaa4 = THj = (R)-2-amino-2-(thiophen-2-yl)acetic acid
CCEXCCNPACAGCY

SEQ ID NO: 2510 - protein, 14 aa, Artificial Sequence
  Synthesized
  Modified Amino Acid (4)..(4): Xaa4 = THk = (S)-2-amino-3-morpholinopropanoic acid
CCEXCCNPACAGCY

SEQ ID NO: 2511 - protein, 14 aa, Artificial Sequence
  Synthesized
  Modified Amino Acid (4)..(4): Xaa4 = THl = (S)-2-amino-2-(pyridin-2-yl)acetic acid
CCEXCCNPACAGCY

SEQ ID NO: 2512 - protein, 14 aa, Artificial Sequence
  Synthesized
  Modified Amino Acid (8)..(8): Xaa8 = PRa = (S)-2,5-dihydro-1H-pyrrole-2-carboxylic acid
CCELCCNXACAGCY

SEQ ID NO: 2513 - protein, 14 aa, Artificial Sequence
  Synthesized
  Modified Amino Acid (8)..(8): Xaa8 = PRb = (S)-piperidine-2-carboxylic acid
CCELCCNXACAGCY

SEQ ID NO: 2514 - protein, 14 aa, Artificial Sequence
  Synthesized
  Modified Amino Acid (8)..(8): Xaa8 = PRc = (S)-azetidine-2-carboxylic acid
CCELCCNXACAGCY

SEQ ID NO: 2515 - protein, 14 aa, Artificial Sequence
  Synthesized
  Modified Amino Acid (8)..(8): Xaa8 = PRd = (S)-azepane-2-carboxylic acid
CCELCCNXACAGCY

SEQ ID NO: 2516 - protein, 14 aa, Artificial Sequence
  Synthesized
  Modified Amino Acid (8)..(8): Xaa8 = PRe = 2-(methylamino)acetic acid
CCELCCNXACAGCY

SEQ ID NO: 2517 - protein, 14 aa, Artificial Sequence
  Synthesized
  Modified Amino Acid (8)..(8): Xaa8 = PRf = (S)-2-aminopropanoic acid
CCELCCNXACAGCY

SEQ ID NO: 2518 - protein, 14 aa, Artificial Sequence
  Synthesized
  Modified Amino Acid (8)..(8): Xaa8 = PRg = 2-amino-2-methylpropanoic acid
CCELCCNXACAGCY

SEQ ID NO: 2519 - protein, 14 aa, Artificial Sequence
  Synthesized
  Modified Amino Acid (8)..(8): Xaa8 = PRh = 2-amino-2,2-difluoroacetic acid
CCELCCNXACAGCY

SEQ ID NO: 2520 - protein, 14 aa, Artificial Sequence
  Synthesized
  Modified Amino Acid (8)..(8): Xaa8 = PRi = (1S,9bS)-2,3,4,4a,5,9b-hexahydro-1H-pyrido[4,3-b]indole-1-carboxy lic acid
CCELCCNXACAGCY

SEQ ID NO: 2521 - protein, 14 aa, Artificial Sequence
  Synthesized
  Modified Amino Acid (8)..(8): Xaa8 = PRj = (S)-1,2,3,4-tetrahydroisoquinoline-3-carboxylic acid
CCELCCNXACAGCY

SEQ ID NO: 2522 - protein, 14 aa, Artificial Sequence
  Synthesized
  Modified Amino Acid (8)..(8): Xaa8 = PRk = (S)-1,2-dihydroazete-2-carboxylic acid
CCELCCNXACAGCY

SEQ ID NO: 2523 - protein, 14 aa, Artificial Sequence
  Synthesized
  Modified Amino Acid (8)..(8): Xaa8 = PRl = (S)-2,5-dihydro-1H-pyrrole-2-carboxylic acid
CCELCCNXACAGCY

SEQ ID NO: 2524 - protein, 14 aa, Artificial Sequence
  Synthesized
  Modified Amino Acid (8)..(8): Xaa8 = PRm = (2S)-4-hydroxypyrrolidine-2-carboxylic acid
CCELCCNXACAGCY

SEQ ID NO: 2525 - protein, 14 aa, Artificial Sequence
  Synthesized
  Modified Amino Acid (8)..(8): Xaa8 = PRn = (S)-5-thioxopyrrolidine-2-carboxylic acid
CCELCCNXACAGCY

SEQ ID NO: 2526 - protein, 14 aa, Artificial Sequence
  Synthesized
  Modified Amino Acid (8)..(8): Xaa8 = PRq = (S)-thiazolidine-2-carboxylic acid
CCELCCNXACAGCY

SEQ ID NO: 2527 - protein, 14 aa, Artificial Sequence
  Synthesized
  Modified Amino Acid (8)..(8): Xaa8 = PRp = (R)-5,5-dimethylthiazolidine-4-carboxylic acid
CCELCCNXACAGCY

SEQ ID NO: 2528 - protein, 14 aa, Artificial Sequence
  Synthesized
  Modified Amino Acid (11)..(11): Xaa11 = PHa = (S)-2-amino-3-phenylpropanoic acid
CCELCCNPACXGCY

SEQ ID NO: 2529 - protein, 14 aa, Artificial Sequence
  Synthesized
  Modified Amino Acid (11)..(11): Xaa11 = PHb = (S)-2-amino-3-(pyridin-4-yl)propanoic acid
CCELCCNPACXGCY

SEQ ID NO: 2530 - protein, 14 aa, Artificial Sequence
  Synthesized
  Modified Amino Acid (11)..(11): Xaa11 = PHc = (S)-2-amino-3-(pyridin-3-yl)propanoic acid
CCELCCNPACXGCY

SEQ ID NO: 2531 - protein, 14 aa, Artificial Sequence
  Synthesized
  Modified Amino Acid (11)..(11): Xaa11 = PHd = (S)-2-amino-3-(pyridin-2-yl)propanoic acid
CCELCCNPACXGCY

SEQ ID NO: 2532 - protein, 14 aa, Artificial Sequence
  Synthesized
  Modified Amino Acid (11)..(11): Xaa11 = PHq = (S)-2-amino-3-(thiophen-2-yl)propanoic acid
CCELCCNPACXGCY

SEQ ID NO: 2533 - protein, 14 aa, Artificial Sequence
  Synthesized
  Modified Amino Acid (11)..(11): Xaa11 = PHf = (S)-1,2,3,4-tetrahydroisoquinoline-3-carboxylic acid
CCELCCNPACXGCY

SEQ ID NO: 2534 - protein, 14 aa, Artificial Sequence
  Synthesized
  Modified Amino Acid (11)..(11): Xaa11 = PHg = (S)-2-aminopent-4-ynoic acid
CCELCCNPACXGCY

SEQ ID NO: 2535 - protein, 14 aa, Artificial Sequence
  Synthesized
  Modified Amino Acid (11)..(11): Xaa11 = PHh = (S)-2,4-diamino-4-iminobutanoic acid
CCELCCNPACXGCY

SEQ ID NO: 2536 - protein, 14 aa, Artificial Sequence
  Synthesized
  Modified Amino Acid (11)..(11): Xaa11 = PHi = (S)-2-amino-4-methylpent-4-enoic acid
CCELCCNPACXGCY

SEQ ID NO: 2537 - protein, 14 aa, Artificial Sequence
  Synthesized
  Modified Amino Acid (11)..(11): Xaa11 = PHj = (S)-2-amino-4-methylpentanoic acid
CCELCCNPACXGCY

SEQ ID NO: 2538 - protein, 14 aa, Artificial Sequence
  Synthesized
  Modified Amino Acid (11)..(11): Xaa11 = PHk = (S)-2-amino-3-cyclopropylpropan-1-ol
CCELCCNPACXGCY

SEQ ID NO: 2539 - protein, 14 aa, Artificial Sequence
  Synthesized
  Modified Amino Acid (11)..(11): Xaa11 = PHl = (S)-2-amino-2-phenylacetic acid
CCELCCNPACXGCY

SEQ ID NO: 2540 - protein, 14 aa, Artificial Sequence
  Synthesized
  Modified Amino Acid (11)..(11): Xaa11 = PHm = (S)-2-amino-3-cyclohexylpropanoic acid
CCELCCNPACXGCY

SEQ ID NO: 2541 - protein, 14 aa, Artificial Sequence
  Synthesized
  Modified Amino Acid (11)..(11): Xaa11 = PHn = (S)-2-amino-3-(piperidin-4-yl)propanoic acid
CCELCCNPACXGCY

SEQ ID NO: 2542 - protein, 14 aa, Artificial Sequence
  Synthesized
  Modified Amino Acid (11)..(11): Xaa11 = PHo = (S)-2-aminohexanoic acid
CCELCCNPACXGCY

SEQ ID NO: 2543 - protein, 14 aa, Artificial Sequence
  Synthesized
  Modified Amino Acid (11)..(11): Xaa11 = PHp = (S)-2-aminopent-4-enoic acid
CCELCCNPACXGCY

What is claimed is:

1. A peptide comprising the amino acid sequence of SEQ ID NO: 60.

2. The peptide of claim 1, further comprising a pharmaceutical carrier, excipient or diluent.

3. The peptide of claim 1 formulated in a unit dose form.

4. The peptide of claim 3, wherein the unit dose form is a powder, a tablet, a capsule, a tablet matrix, a suppository, a controlled release formulation, a delayed release formulation, a slow release formulation, a sustained release formulation, a colonic release formulation, an oral formulation, a bead formulation, a microencapsulated delivery system, a fluid carrier, a solution, a gelatin capsule, or a liposomal suspension.

5. The pharmaceutical composition of claim 4, wherein the unit dose form is a controlled release formulation.

6. A method for treating a disease or a disorder, wherein the method comprises administering to a patient in need thereof a therapeutically effective amount of a peptide comprising the amino acid sequence of SEQ ID NO: 60, wherein the disease or disorder is selected from the group consisting of constipation, chronic idiopathic constipation, irritable bowel syndrome with constipation, opioid induced constipation, post-surgical constipation.

7. A peptide comprising the amino acid sequence of SEQ ID NO: 63.

8. The peptide of claim 7, further comprising a pharmaceutical carrier, excipient or diluent.

9. The peptide of claim 7 formulated in a unit dose form.

10. The peptide of claim 9, wherein the unit dose form is a powder, a tablet, a capsule, a tablet matrix, a suppository, a controlled release formulation, a delayed release formulation, a slow release formulation, a sustained release formulation, a colonic release formulation, an oral formulation, a bead formulation, a microencapsulated delivery system, a fluid carrier, a solution, a gelatin capsule, or a liposomal suspension.

11. The pharmaceutical composition of claim 10, wherein the unit dose form is a controlled release formulation.

12. A method for treating a disease or a disorder, wherein the method comprises administering to a patient in need thereof a therapeutically effective amount of a peptide comprising the amino acid sequence of SEQ ID NO: 63, wherein the disease or disorder is selected from the group consisting of constipation, chronic idiopathic constipation, irritable bowel syndrome with constipation, opioid induced constipation, post-surgical constipation.

* * * * *